United States Patent 12,097,253 (RSV RNA MOLECULES AND COMPOSITIONS FOR VACCINATION) - sequence listing, part 8

SEQ ID NO: 10372 - RNA, 1532 nt, synthetic construct
  misc_feature 1..1532: note = mRNA product Design f-3 comprising derived and/or modified sequence from HRSV(A2)__P03418.1__N (opt5)
  source 1..1532: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10373 - RNA, 1532 nt, synthetic construct
  misc_feature 1..1532: note = mRNA product Design f-3 comprising derived and/or modified sequence from HRSV(A2)__P03418.1__N (opt6)
  source 1..1532: mol_type = other RNA
gggagagtcccgcagtcggcgtccagcggctctgcttgttcgtgtgtgtgtcgttgcaggccttattcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10374 - RNA, 1532 nt, synthetic construct
  misc_feature 1..1532: note = mRNA product Design f-3 comprising derived and/or modified sequence from HRSV(A2)__P03418.1__N (opt11)
  source 1..1532: mol_type = other RNA
gggagagtcccgcagtcggcgtccagcggctctgcttgttcgtgtgtgtgtcgttgcaggccttattcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10375 - RNA, 1748 nt, synthetic construct
  misc_feature 1..1748: note = mRNA product Design f-4 comprising derived and/or modified sequence from HRSV(A2)__P03418.1__N (wt)
  source 1..1748: mol_type = other RNA
gggagagtcccgcagtcggcgtccagcggctctgcttgttcgtgtgtgtgtcgttgcaggccttattcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10376 - RNA, 1748 nt, synthetic construct
  misc_feature 1..1748: note = mRNA product Design f-4 comprising derived and/or modified sequence from HRSV(A2)__P03418.1__N (opt1)
  source 1..1748: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10377 - RNA, 1748 nt, synthetic construct
  misc_feature 1..1748: note = mRNA product Design f-4 comprising derived and/or modified sequence from HRSV(A2)__P03418.1__N (opt2)
  source 1..1748: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10378 - RNA, 1748 nt, synthetic construct
  misc_feature 1..1748: note = mRNA product Design f-4 comprising derived and/or modified sequence from HRSV(A2)__P03418.1__N (opt3)
  source 1..1748: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10379 - RNA, 1748 nt, synthetic construct
  misc_feature 1..1748: note = mRNA product Design f-4 comprising derived and/or modified sequence from HRSV(A2)__P03418.1__N (opt4)
  source 1..1748: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10380 - RNA, 1748 nt, synthetic construct
  misc_feature 1..1748: note = mRNA product Design f-4 comprising derived and/or modified sequence from HRSV(A2)__P03418.1__N (opt5)
  source 1..1748: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10381 - RNA, 1748 nt, synthetic construct
  misc_feature 1..1748: note = mRNA product Design f-4 comprising derived and/or modified sequence from HRSV(A2)__P03418.1__N (opt6)
  source 1..1748: mol_type = other RNA
gggagagtcccgcagtcggcgtccagcggctctgcttgttcgtgtgtgtgtcgttgcaggccttattcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10382 - RNA, 1748 nt, synthetic construct
  misc_feature 1..1748: note = mRNA product Design f-4 comprising derived and/or modified sequence from HRSV(A2)__P03418.1__N (opt11)
  source 1..1748: mol_type = other RNA
gggagagtcccgcagtcggcgtccagcggctctgcttgttcgtgtgtgtgtcgttgcaggccttattcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10383 - RNA, 1524 nt, synthetic construct
  misc_feature 1..1524: note = mRNA product Design f-5 comprising derived and/or modified sequence from HRSV(A2)__P03418.1__N (wt)
  source 1..1524: mol_type = other RNA
gggagactttcccattctgtagcagaatttggtgttgcctgtggtcttggtcccgcggagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10384 - RNA, 1524 nt, synthetic construct
  misc_feature 1..1524: note = mRNA product Design f-5 comprising derived and/or modified sequence from HRSV(A2)__P03418.1__N (opt1)
  source 1..1524: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10385 - RNA, 1524 nt, synthetic construct
  misc_feature 1..1524: note = mRNA product Design f-5 comprising derived and/or modified sequence from HRSV(A2)__P03418.1__N (opt2)
  source 1..1524: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10386 - RNA, 1524 nt, synthetic construct
  misc_feature 1..1524: note = mRNA product Design f-5 comprising derived and/or modified sequence from HRSV(A2)__P03418.1__N (opt3)
  source 1..1524: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10387 - RNA, 1524 nt, synthetic construct
  misc_feature 1..1524: note = mRNA product Design f-5 comprising derived and/or modified sequence from HRSV(A2)__P03418.1__N (opt4)
  source 1..1524: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10388 - RNA, 1524 nt, synthetic construct
  misc_feature 1..1524: note = mRNA product Design f-5 comprising derived and/or modified sequence from HRSV(A2)__P03418.1__N (opt5)
  source 1..1524: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10389 - RNA, 1524 nt, synthetic construct
  misc_feature 1..1524: note = mRNA product Design f-5 comprising derived and/or modified sequence from HRSV(A2)__P03418.1__N (opt6)
  source 1..1524: mol_type = other RNA
gggagactttcccattctgtagcagaatttggtgttgcctgtggtcttggtcccgcggagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10390 - RNA, 1524 nt, synthetic construct
  misc_feature 1..1524: note = mRNA product Design f-5 comprising derived and/or modified sequence from HRSV(A2)__P03418.1__N (opt11)
  source 1..1524: mol_type = other RNA
gggagactttcccattctgtagcagaatttggtgttgcctgtggtcttggtcccgcggagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10391 - RNA, 1520 nt, synthetic construct
  misc_feature 1..1520: note = mRNA product Design g-1 comprising derived and/or modified sequence from HRSV(A2)__P03418.1__N (wt)
  source 1..1520: mol_type = other RNA
gggagactttcccattctgtagcagaatttggtgttgcctgtggtcttggtcccgcggagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10392 - RNA, 1520 nt, synthetic construct
  misc_feature 1..1520: note = mRNA product Design g-1 comprising derived and/or modified sequence from HRSV(A2)__P03418.1__N (opt1)
  source 1..1520: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10393 - RNA, 1520 nt, synthetic construct
  misc_feature 1..1520: note = mRNA product Design g-1 comprising derived and/or modified sequence from HRSV(A2)__P03418.1__N (opt2)
  source 1..1520: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10394 - RNA, 1520 nt, synthetic construct
  misc_feature 1..1520: note = mRNA product Design g-1 comprising derived and/or modified sequence from HRSV(A2)__P03418.1__N (opt3)
  source 1..1520: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10395 - RNA, 1520 nt, synthetic construct
  misc_feature 1..1520: note = mRNA product Design g-1 comprising derived and/or modified sequence from HRSV(A2)__P03418.1__N (opt4)
  source 1..1520: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10396 - RNA, 1520 nt, synthetic construct
  misc_feature 1..1520: note = mRNA product Design g-1 comprising derived and/or modified sequence from HRSV(A2)__P03418.1__N (opt5)
  source 1..1520: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10397 - RNA, 1520 nt, synthetic construct
  misc_feature 1..1520: note = mRNA product Design g-1 comprising derived and/or modified sequence from HRSV(A2)__P03418.1__N (opt6)
  source 1..1520: mol_type = other RNA
gggagactttcccattctgtagcagaatttggtgttgcctgtggtcttggtcccgcggagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10398 - RNA, 1520 nt, synthetic construct
  misc_feature 1..1520: note = mRNA product Design g-1 comprising derived and/or modified sequence from HRSV(A2)__P03418.1__N (opt11)
  source 1..1520: mol_type = other RNA
gggagactttcccattctgtagcagaatttggtgttgcctgtggtcttggtcccgcggagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10399 - RNA, 1535 nt, synthetic construct
  misc_feature 1..1535: note = mRNA product Design g-2 comprising derived and/or modified sequence from HRSV(A2)__P03418.1__N (wt)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10400 - RNA, 1535 nt, synthetic construct
  misc_feature 1..1535: note = mRNA product Design g-2 comprising derived and/or modified sequence from HRSV(A2)__P03418.1__N (opt1)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10401 - RNA, 1535 nt, synthetic construct
  misc_feature 1..1535: note = mRNA product Design g-2 comprising derived and/or modified sequence from HRSV(A2)__P03418.1__N (opt2)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10402 - RNA, 1535 nt, synthetic construct
  misc_feature 1..1535: note = mRNA product Design g-2 comprising derived and/or modified sequence from HRSV(A2)__P03418.1__N (opt3)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10403 - RNA, 1535 nt, synthetic construct
  misc_feature 1..1535: note = mRNA product Design g-2 comprising derived and/or modified sequence from HRSV(A2)__P03418.1__N (opt4)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10404 - RNA, 1535 nt, synthetic construct
  misc_feature 1..1535: note = mRNA product Design g-2 comprising derived and/or modified sequence from HRSV(A2)__P03418.1__N (opt5)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10405 - RNA, 1535 nt, synthetic construct
  misc_feature 1..1535: note = mRNA product Design g-2 comprising derived and/or modified sequence from HRSV(A2)__P03418.1__N (opt6)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10406 - RNA, 1535 nt, synthetic construct
  misc_feature 1..1535: note = mRNA product Design g-2 comprising derived and/or modified sequence from HRSV(A2)__P03418.1__N (opt11)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10407 - RNA, 1767 nt, synthetic construct
  misc_feature 1..1767: note = mRNA product Design g-3 comprising derived and/or modified sequence from HRSV(A2)__P03418.1__N (wt)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10408 - RNA, 1767 nt, synthetic construct
  misc_feature 1..1767: note = mRNA product Design g-3 comprising derived and/or modified sequence from HRSV(A2)__P03418.1__N (opt1)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10409 - RNA, 1767 nt, synthetic construct
  misc_feature 1..1767: note = mRNA product Design g-3 comprising derived and/or modified sequence from HRSV(A2)__P03418.1__N (opt2)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10410 - RNA, 1767 nt, synthetic construct
  misc_feature 1..1767: note = mRNA product Design g-3 comprising derived and/or modified sequence from HRSV(A2)__P03418.1__N (opt3)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10411 - RNA, 1767 nt, synthetic construct
  misc_feature 1..1767: note = mRNA product Design g-3 comprising derived and/or modified sequence from HRSV(A2)__P03418.1__N (opt4)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10412 - RNA, 1767 nt, synthetic construct
  misc_feature 1..1767: note = mRNA product Design g-3 comprising derived and/or modified sequence from HRSV(A2)__P03418.1__N (opt5)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10413 - RNA, 1767 nt, synthetic construct
  misc_feature 1..1767: note = mRNA product Design g-3 comprising derived and/or modified sequence from HRSV(A2)__P03418.1__N (opt6)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10414 - RNA, 1767 nt, synthetic construct
  misc_feature 1..1767: note = mRNA product Design g-3 comprising derived and/or modified sequence from HRSV(A2)__P03418.1__N (opt11)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10415 - RNA, 1562 nt, synthetic construct
  misc_feature 1..1562: note = mRNA product Design g-4 comprising derived and/or modified sequence from HRSV(A2)__P03418.1__N (wt)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10416 - RNA, 1562 nt, synthetic construct
  misc_feature 1..1562: note = mRNA product Design g-4 comprising derived and/or modified sequence from HRSV(A2)__P03418.1__N (opt1)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10417 - RNA, 1562 nt, synthetic construct
  misc_feature 1..1562: note = mRNA product Design g-4 comprising derived and/or modified sequence from HRSV(A2)__P03418.1__N (opt2)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10418 - RNA, 1562 nt, synthetic construct
  misc_feature 1..1562: note = mRNA product Design g-4 comprising derived and/or modified sequence from HRSV(A2)__P03418.1__N (opt3)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10419 - RNA, 1562 nt, synthetic construct
  misc_feature 1..1562: note = mRNA product Design g-4 comprising derived and/or modified sequence from HRSV(A2)__P03418.1__N (opt4)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10420 - RNA, 1562 nt, synthetic construct
  misc_feature 1..1562: note = mRNA product Design g-4 comprising derived and/or modified sequence from HRSV(A2)__P03418.1__N (opt5)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10421 - RNA, 1562 nt, synthetic construct
  misc_feature 1..1562: note = mRNA product Design g-4 comprising derived and/or modified sequence from HRSV(A2)__P03418.1__N (opt6)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10422 - RNA, 1562 nt, synthetic construct
  misc_feature 1..1562: note = mRNA product Design g-4 comprising derived and/or modified sequence from HRSV(A2)__P03418.1__N (opt11)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10423 - RNA, 1538 nt, synthetic construct
  misc_feature 1..1538: note = mRNA product Design g-5 comprising derived and/or modified sequence from HRSV(A2)__P03418.1__N (wt)
  source 1..1538: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10424 - RNA, 1538 nt, synthetic construct
  misc_feature 1..1538: note = mRNA product Design g-5 comprising derived and/or modified sequence from HRSV(A2)__P03418.1__N (opt1)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10425 - RNA, 1538 nt, synthetic construct
  misc_feature 1..1538: note = mRNA product Design g-5 comprising derived and/or modified sequence from HRSV(A2)__P03418.1__N (opt2)
  source 1..1538: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10426 - RNA, 1538 nt, synthetic construct
  misc_feature 1..1538: note = mRNA product Design g-5 comprising derived and/or modified sequence from HRSV(A2)__P03418.1__N (opt3)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10427 - RNA, 1538 nt, synthetic construct
  misc_feature 1..1538: note = mRNA product Design g-5 comprising derived and/or modified sequence from HRSV(A2)__P03418.1__N (opt4)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10428 - RNA, 1538 nt, synthetic construct
  misc_feature 1..1538: note = mRNA product Design g-5 comprising derived and/or modified sequence from HRSV(A2)__P03418.1__N (opt5)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10429 - RNA, 1538 nt, synthetic construct
  misc_feature 1..1538: note = mRNA product Design g-5 comprising derived and/or modified sequence from HRSV(A2)__P03418.1__N (opt6)
  source 1..1538: mol_type = other RNA
gggagacccgtgacccggaagttgtacggctacgcgactttccctcccacaaaccctcgcgcccttcctttcctacttgggcccggcagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10430 - RNA, 1538 nt, synthetic construct
  misc_feature 1..1538: note = mRNA product Design g-5 comprising derived and/or modified sequence from HRSV(A2)__P03418.1__N (opt11)
  source 1..1538: mol_type = other RNA
gggagacccgtgacccggaagttgtacggctacgcgactttccctcccacaaaccctcgcgcccttcctttcctacttgggcccggcagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10431 - RNA, 1554 nt, synthetic construct
  misc_feature 1..1554: note = mRNA product Design h-1 comprising derived and/or modified sequence from HRSV(A2)__P03418.1__N (wt)
  source 1..1554: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10432 - RNA, 1554 nt, synthetic construct
  misc_feature 1..1554: note = mRNA product Design h-1 comprising derived and/or modified sequence from HRSV(A2)__P03418.1__N (opt1)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10433 - RNA, 1554 nt, synthetic construct
  misc_feature 1..1554: note = mRNA product Design h-1 comprising derived and/or modified sequence from HRSV(A2)__P03418.1__N (opt2)
  source 1..1554: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10434 - RNA, 1554 nt, synthetic construct
  misc_feature 1..1554: note = mRNA product Design h-1 comprising derived and/or modified sequence from HRSV(A2)__P03418.1__N (opt3)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10435 - RNA, 1554 nt, synthetic construct
  misc_feature 1..1554: note = mRNA product Design h-1 comprising derived and/or modified sequence from HRSV(A2)__P03418.1__N (opt4)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10436 - RNA, 1554 nt, synthetic construct
  misc_feature 1..1554: note = mRNA product Design h-1 comprising derived and/or modified sequence from HRSV(A2)__P03418.1__N (opt5)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10437 - RNA, 1554 nt, synthetic construct
  misc_feature 1..1554: note = mRNA product Design h-1 comprising derived and/or modified sequence from HRSV(A2)__P03418.1__N (opt6)
  source 1..1554: mol_type = other RNA
gggagacccgtgacccggaagttgtacggctacgcgactttccctcccacaaaccctcgcgcccttcctttcctacttgggcccggcagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10438 - RNA, 1554 nt, synthetic construct
  misc_feature 1..1554: note = mRNA product Design h-1 comprising derived and/or modified sequence from HRSV(A2)__P03418.1__N (opt11)
  source 1..1554: mol_type = other RNA
gggagacccgtgacccggaagttgtacggctacgcgactttccctcccacaaaccctcgcgcccttcctttcctacttgggcccggcagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10439 - RNA, 1770 nt, synthetic construct
  misc_feature 1..1770: note = mRNA product Design h-2 comprising derived and/or modified sequence from HRSV(A2)__P03418.1__N (wt)
  source 1..1770: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10440 - RNA, 1770 nt, synthetic construct
  misc_feature 1..1770: note = mRNA product Design h-2 comprising derived and/or modified sequence from HRSV(A2)__P03418.1__N (opt1)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10441 - RNA, 1770 nt, synthetic construct
  misc_feature 1..1770: note = mRNA product Design h-2 comprising derived and/or modified sequence from HRSV(A2)__P03418.1__N (opt2)
  source 1..1770: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10442 - RNA, 1770 nt, synthetic construct
  misc_feature 1..1770: note = mRNA product Design h-2 comprising derived and/or modified sequence from HRSV(A2)__P03418.1__N (opt3)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10443 - RNA, 1770 nt, synthetic construct
  misc_feature 1..1770: note = mRNA product Design h-2 comprising derived and/or modified sequence from HRSV(A2)__P03418.1__N (opt4)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10444 - RNA, 1770 nt, synthetic construct
  misc_feature 1..1770: note = mRNA product Design h-2 comprising derived and/or modified sequence from HRSV(A2)__P03418.1__N (opt5)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10445 - RNA, 1770 nt, synthetic construct
  misc_feature 1..1770: note = mRNA product Design h-2 comprising derived and/or modified sequence from HRSV(A2)__P03418.1__N (opt6)
  source 1..1770: mol_type = other RNA
gggagacccgtgacccggaagttgtacggctacgcgactttccctcccacaaaccctcgcgcccttcctttcctacttgggcccggcagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10446 - RNA, 1770 nt, synthetic construct
  misc_feature 1..1770: note = mRNA product Design h-2 comprising derived and/or modified sequence from HRSV(A2)__P03418.1__N (opt11)
  source 1..1770: mol_type = other RNA
gggagacccgtgacccggaagttgtacggctacgcgactttccctcccacaaaccctcgcgcccttcctttcctacttgggcccggcagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10447 - RNA, 1550 nt, synthetic construct
  misc_feature 1..1550: note = mRNA product Design h-3 comprising derived and/or modified sequence from HRSV(A2)__P03418.1__N (wt)
  source 1..1550: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10448 - RNA, 1550 nt, synthetic construct
  misc_feature 1..1550: note = mRNA product Design h-3 comprising derived and/or modified sequence from HRSV(A2)__P03418.1__N (opt1)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10449 - RNA, 1550 nt, synthetic construct
  misc_feature 1..1550: note = mRNA product Design h-3 comprising derived and/or modified sequence from HRSV(A2)__P03418.1__N (opt2)
  source 1..1550: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10450 - RNA, 1550 nt, synthetic construct
  misc_feature 1..1550: note = mRNA product Design h-3 comprising derived and/or modified sequence from HRSV(A2)__P03418.1__N (opt3)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10451 - RNA, 1550 nt, synthetic construct
  misc_feature 1..1550: note = mRNA product Design h-3 comprising derived and/or modified sequence from HRSV(A2)__P03418.1__N (opt4)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10452 - RNA, 1550 nt, synthetic construct
  misc_feature 1..1550: note = mRNA product Design h-3 comprising derived and/or modified sequence from HRSV(A2)__P03418.1__N (opt5)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10453 - RNA, 1550 nt, synthetic construct
  misc_feature 1..1550: note = mRNA product Design h-3 comprising derived and/or modified sequence from HRSV(A2)__P03418.1__N (opt6)
  source 1..1550: mol_type = other RNA
gggagacccgtgacccggaagttgtacggctacgcgactttccctcccacaaaccctcgcgcccttcctttcctacttgggcccggcagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10454 - RNA, 1550 nt, synthetic construct
  misc_feature 1..1550: note = mRNA product Design h-3 comprising derived and/or modified sequence from HRSV(A2)__P03418.1__N (opt11)
  source 1..1550: mol_type = other RNA
gggagacccgtgacccggaagttgtacggctacgcgactttccctcccacaaaccctcgcgcccttcctttcctacttgggcccggcagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10455 - RNA, 1613 nt, synthetic construct
  misc_feature 1..1613: note = mRNA product Design h-4 comprising derived and/or modified sequence from HRSV(A2)__P03418.1__N (wt)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10456 - RNA, 1613 nt, synthetic construct
  misc_feature 1..1613: note = mRNA product Design h-4 comprising derived and/or modified sequence from HRSV(A2)__P03418.1__N (opt1)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10457 - RNA, 1613 nt, synthetic construct
  misc_feature 1..1613: note = mRNA product Design h-4 comprising derived and/or modified sequence from HRSV(A2)__P03418.1__N (opt2)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10458 - RNA, 1613 nt, synthetic construct
  misc_feature 1..1613: note = mRNA product Design h-4 comprising derived and/or modified sequence from HRSV(A2)__P03418.1__N (opt3)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10459 - RNA, 1613 nt, synthetic construct
  misc_feature 1..1613: note = mRNA product Design h-4 comprising derived and/or modified sequence from HRSV(A2)__P03418.1__N (opt4)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10460 - RNA, 1613 nt, synthetic construct
  misc_feature 1..1613: note = mRNA product Design h-4 comprising derived and/or modified sequence from HRSV(A2)__P03418.1__N (opt5)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10461 - RNA, 1613 nt, synthetic construct
  misc_feature 1..1613: note = mRNA product Design h-4 comprising derived and/or modified sequence from HRSV(A2)__P03418.1__N (opt6)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10462 - RNA, 1613 nt, synthetic construct
  misc_feature 1..1613: note = mRNA product Design h-4 comprising derived and/or modified sequence from HRSV(A2)__P03418.1__N (opt11)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10463 - RNA, 1629 nt, synthetic construct
  misc_feature 1..1629: note = mRNA product Design h-5 comprising derived and/or modified sequence from HRSV(A2)__P03418.1__N (wt)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10464 - RNA, 1629 nt, synthetic construct
  misc_feature 1..1629: note = mRNA product Design h-5 comprising derived and/or modified sequence from HRSV(A2)__P03418.1__N (opt1)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10465 - RNA, 1629 nt, synthetic construct
  misc_feature 1..1629: note = mRNA product Design h-5 comprising derived and/or modified sequence from HRSV(A2)__P03418.1__N (opt2)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10466 - RNA, 1629 nt, synthetic construct
  misc_feature 1..1629: note = mRNA product Design h-5 comprising derived and/or modified sequence from HRSV(A2)__P03418.1__N (opt3)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10467 - RNA, 1629 nt, synthetic construct
  misc_feature 1..1629: note = mRNA product Design h-5 comprising derived and/or modified sequence from HRSV(A2)__P03418.1__N (opt4)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10468 - RNA, 1629 nt, synthetic construct
  misc_feature 1..1629: note = mRNA product Design h-5 comprising derived and/or modified sequence from HRSV(A2)__P03418.1__N (opt5)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10469 - RNA, 1629 nt, synthetic construct
  misc_feature 1..1629: note = mRNA product Design h-5 comprising derived and/or modified sequence from HRSV(A2)__P03418.1__N (opt6)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10470 - RNA, 1629 nt, synthetic construct
  misc_feature 1..1629: note = mRNA product Design h-5 comprising derived and/or modified sequence from HRSV(A2)__P03418.1__N (opt11)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10471 - RNA, 1562 nt, synthetic construct
  misc_feature 1..1562: note = mRNA product Design i-1 comprising derived and/or modified sequence from HRSV(A2)__P03418.1__N (wt)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10472 - RNA, 1562 nt, synthetic construct
  misc_feature 1..1562: note = mRNA product Design i-1 comprising derived and/or modified sequence from HRSV(A2)__P03418.1__N (opt1)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10473 - RNA, 1562 nt, synthetic construct
  misc_feature 1..1562: note = mRNA product Design i-1 comprising derived and/or modified sequence from HRSV(A2)__P03418.1__N (opt2)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10474 - RNA, 1562 nt, synthetic construct
  misc_feature 1..1562: note = mRNA product Design i-1 comprising derived and/or modified sequence from HRSV(A2)__P03418.1__N (opt3)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10475 - RNA, 1562 nt, synthetic construct
  misc_feature 1..1562: note = mRNA product Design i-1 comprising derived and/or modified sequence from HRSV(A2)__P03418.1__N (opt4)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10476 - RNA, 1562 nt, synthetic construct
  misc_feature 1..1562: note = mRNA product Design i-1 comprising derived and/or modified sequence from HRSV(A2)__P03418.1__N (opt5)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10477 - RNA, 1562 nt, synthetic construct
  misc_feature 1..1562: note = mRNA product Design i-1 comprising derived and/or modified sequence from HRSV(A2)__P03418.1__N (opt6)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10478 - RNA, 1562 nt, synthetic construct
  misc_feature 1..1562: note = mRNA product Design i-1 comprising derived and/or modified sequence from HRSV(A2)__P03418.1__N (opt11)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10479 - RNA, 1562 nt, synthetic construct
  misc_feature 1..1562: note = mRNA product Design i-2 comprising derived and/or modified sequence from HRSV(A2)__P03418.1__N (wt)
  source 1..1562: mol_type = other RNA
gggagaggcgctgcctacggaggtggcagccatctccttctcggcatcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10480 - RNA, 1562 nt, synthetic construct
  misc_feature 1..1562: note = mRNA product Design i-2 comprising derived and/or modified sequence from HRSV(A2)__P03418.1__N (opt1)
  source 1..1562: mol_type = other RNA
gggagaggcgctgcctacggaggtggcagccatctccttctcggcatcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10481 - RNA, 1562 nt, synthetic construct
  misc_feature 1..1562: note = mRNA product Design i-2 comprising derived and/or modified sequence from HRSV(A2)__P03418.1__N (opt2)
  source 1..1562: mol_type = other RNA
gggagaggcgctgcctacggaggtggcagccatctccttctcggcatcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10482 - RNA, 1562 nt, synthetic construct
  misc_feature 1..1562: note = mRNA product Design i-2 comprising derived and/or modified sequence from HRSV(A2)__P03418.1__N (opt3)
  source 1..1562: mol_type = other RNA
gggagaggcgctgcctacggaggtggcagccatctccttctcggcatcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10483 - RNA, 1562 nt, synthetic construct
  misc_feature 1..1562: note = mRNA product Design i-2 comprising derived and/or modified sequence from HRSV(A2)__P03418.1__N (opt4)
  source 1..1562: mol_type = other RNA
gggagaggcgctgcctacggaggtggcagccatctccttctcggcatcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10484 - RNA, 1562 nt, synthetic construct
  misc_feature 1..1562: note = mRNA product Design i-2 comprising derived and/or modified sequence from HRSV(A2)__P03418.1__N (opt5)
  source 1..1562: mol_type = other RNA
gggagaggcgctgcctacggaggtggcagccatctccttctcggcatcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10485 - RNA, 1562 nt, synthetic construct
  misc_feature 1..1562: note = mRNA product Design i-2 comprising derived and/or modified sequence from HRSV(A2)__P03418.1__N (opt6)
  source 1..1562: mol_type = other RNA
gggagaggcgctgcctacggaggtggcagccatctccttctcggcatcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10486 - RNA, 1562 nt, synthetic construct
  misc_feature 1..1562: note = mRNA product Design i-2 comprising derived and/or modified sequence from HRSV(A2)__P03418.1__N (opt11)
  source 1..1562: mol_type = other RNA
gggagaggcgctgcctacggaggtggcagccatctccttctcggcatcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10487 - RNA, 1558 nt, synthetic construct
  misc_feature 1..1558: note = mRNA product Design i-2 comprising derived and/or modified sequence from HRSV(A2)__P03418.1__N (wt)
  source 1..1558: mol_type = other RNA
ggggcgctgcctacggaggtggcagccatctccttctcggcatcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10488 - RNA, 1558 nt, synthetic construct
  misc_feature 1..1558: note = mRNA product Design i-2 comprising derived and/or modified sequence from HRSV(A2)__P03418.1__N (opt1)
  source 1..1558: mol_type = other RNA
ggggcgctgcctacggaggtggcagccatctccttctcggcatcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10489 - RNA, 1558 nt, synthetic construct
  misc_feature 1..1558: note = mRNA product Design i-2 comprising derived and/or modified sequence from HRSV(A2)__P03418.1__N (opt2)
  source 1..1558: mol_type = other RNA
ggggcgctgcctacggaggtggcagccatctccttctcggcatcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10490 - RNA, 1558 nt, synthetic construct
  misc_feature 1..1558: note = mRNA product Design i-2 comprising derived and/or modified sequence from HRSV(A2)__P03418.1__N (opt3)
  source 1..1558: mol_type = other RNA
ggggcgctgcctacggaggtggcagccatctccttctcggcatcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10491 - RNA, 1558 nt, synthetic construct
  misc_feature 1..1558: note = mRNA product Design i-2 comprising derived and/or modified sequence from HRSV(A2)__P03418.1__N (opt4)
  source 1..1558: mol_type = other RNA
ggggcgctgcctacggaggtggcagccatctccttctcggcatcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10492 - RNA, 1558 nt, synthetic construct
  misc_feature 1..1558: note = mRNA product Design i-2 comprising derived and/or modified sequence from HRSV(A2)__P03418.1__N (opt5)
  source 1..1558: mol_type = other RNA
ggggcgctgcctacggaggtggcagccatctccttctcggcatcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10493 - RNA, 1558 nt, synthetic construct
  misc_feature 1..1558: note = mRNA product Design i-2 comprising derived and/or modified sequence from HRSV(A2)__P03418.1__N (opt6)
  source 1..1558: mol_type = other RNA
ggggcgctgcctacggaggtggcagccatctccttctcggcatcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10494 - RNA, 1558 nt, synthetic construct
  misc_feature 1..1558: note = mRNA product Design i-2 comprising derived and/or modified sequence from HRSV(A2)__P03418.1__N (opt11)
  source 1..1558: mol_type = other RNA
ggggcgctgcctacggaggtggcagccatctccttctcggcatcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10495 - RNA, 1393 nt, synthetic construct
  misc_feature 1..1393: note = mRNA product Design i-3 comprising derived and/or modified sequence from HRSV(A2)__P03418.1__N (wt)
  source 1..1393: mol_type = other RNA
gggagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10496 - RNA, 1393 nt, synthetic construct
  misc_feature 1..1393: note = mRNA product Design i-3 comprising derived and/or modified sequence from HRSV(A2)__P03418.1__N (opt1) R7597
  source 1..1393: mol_type = other RNA
gggagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10497 - RNA, 1393 nt, synthetic construct
  misc_feature 1..1393: note = mRNA product Design i-3 comprising derived and/or modified sequence from HRSV(A2)__P03418.1__N (opt2)
  source 1..1393: mol_type = other RNA
gggagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10498 - RNA, 1393 nt, synthetic construct
  misc_feature 1..1393: note = mRNA product Design i-3 comprising derived and/or modified sequence from HRSV(A2)__P03418.1__N (opt3)
  source 1..1393: mol_type = other RNA
gggagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10499 - RNA, 1393 nt, synthetic construct
  misc_feature 1..1393: note = mRNA product Design i-3 comprising derived and/or modified sequence from HRSV(A2)__P03418.1__N (opt4)
  source 1..1393: mol_type = other RNA
gggagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10500 - RNA, 1393 nt, synthetic construct
  misc_feature 1..1393: note = mRNA product Design i-3 comprising derived and/or modified sequence from HRSV(A2)__P03418.1__N (opt5)
  source 1..1393: mol_type = other RNA
gggagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10501 - RNA, 1393 nt, synthetic construct
  misc_feature 1..1393: note = mRNA product Design i-3 comprising derived and/or modified sequence from HRSV(A2)__P03418.1__N (opt6)
  source 1..1393: mol_type = other RNA
gggagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10502 - RNA, 1393 nt, synthetic construct
  misc_feature 1..1393: note = mRNA product Design i-3 comprising derived and/or modified sequence from HRSV(A2)__P03418.1__N (opt11)
  source 1..1393: mol_type = other RNA
gggagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10503 - protein, 391 aa, synthetic construct
  REGION 1..391: note = derived and/or modified protein sequence (wt) from HRSV(Memphis-37)__AIY60635.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10504 - protein, 391 aa, synthetic construct
  REGION 1..391: note = derived and/or modified protein sequence (wt) from HRSV__O42053.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKNQLNPKEDDVEL

SEQ ID NO: 10505 - protein, 391 aa, synthetic construct
  REGION 1..391: note = derived and/or modified protein sequence (wt) from HRSV__AAC55964.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSIKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10506 - protein, 391 aa, synthetic construct
  REGION 1..391: note = derived and/or modified protein sequence (wt) from HRSV__AAR14261.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10507 - protein, 391 aa, synthetic construct
  REGION 1..391: note = derived and/or modified protein sequence (wt) from HRSV__ABG81855.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILSNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10508 - protein, 391 aa, synthetic construct
  REGION 1..391: note = derived and/or modified protein sequence (wt) from HRSV__ABG81856.1__N
MALSKVKLNDTLNKDQLLSSSKYTIQRSTGDSIDTPNYDVQKHINKLCGMLLITEDANHKFTGLIGMLYAMPRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVRAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10509 - protein, 391 aa, synthetic construct
  REGION 1..391: note = derived and/or modified protein sequence (wt) from HRSV__ABG81857.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10510 - protein, 391 aa, synthetic construct
  REGION 1..391: note = derived and/or modified protein sequence (wt) from HRSV__ABG81859.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPQEDDVEL

SEQ ID NO: 10511 - protein, 391 aa, synthetic construct
  REGION 1..391: note = derived and/or modified protein sequence (wt) from HRSV__ABG81860.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYCVLDLTAEELEAIKHQLNPKEDDVEL

SEQ ID NO: 10512 - protein, 391 aa, synthetic construct
  REGION 1..391: note = derived and/or modified protein sequence (wt) from HRSV__AEO45825.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10513 - protein, 391 aa, synthetic construct
  REGION 1..391: note = derived and/or modified protein sequence (wt) from HRSV__AEO45884.1__N
MALSKVKLNDTLNKDQLLSSSKYTIQRSTGDSIDTPNYDVQKHINKLCGMLLITEDANHKFTGLIGMLYAMFRLGREDTIKILKDAGYHVKANGVDITTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10514 - protein, 391 aa, synthetic construct
  REGION 1..391: note = derived and/or modified protein sequence (wt) from HRSV__AEO45904.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10515 - protein, 391 aa, synthetic construct
  REGION 1..391: note = derived and/or modified protein sequence (wt) from HRSV__AEO45914.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDITTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10516 - protein, 391 aa, synthetic construct
  REGION 1..391: note = derived and/or modified protein sequence (wt) from HRSV__AEO45924.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEDLEAIKHQLNPKDNDVEL

SEQ ID NO: 10517 - protein, 391 aa, synthetic construct
  REGION 1..391: note = derived and/or modified protein sequence (wt) from HRSV__AEQ63439.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRAHNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10518 - protein, 391 aa, synthetic construct
  REGION 1..391: note = derived and/or modified protein sequence (wt) from HRSV__AEQ63515.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDITTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10519 - protein, 391 aa, synthetic construct
  REGION 1..391: note = derived and/or modified protein sequence (wt) from HRSV__AEQ63581.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10520 - protein, 391 aa, synthetic construct
  REGION 1..391: note = derived and/or modified protein sequence (wt) from HRSV__AEQ63625.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIIGEYRGTPRNQDLYDAAKAYAEQLKENGVINYSVLDLTTEELEAIKHQLNPKEDDVEL

SEQ ID NO: 10521 - protein, 391 aa, synthetic construct
  REGION 1..391: note = derived and/or modified protein sequence (wt) from HRSV__AFI25257.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLTKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10522 - protein, 391 aa, synthetic construct
  REGION 1..391: note = derived and/or modified protein sequence (wt) from HRSV__AFM55228.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQTNIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10523 - protein, 391 aa, synthetic construct
  REGION 1..391: note = derived and/or modified protein sequence (wt) from HRSV__AFM55250.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLTSLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10524 - protein, 391 aa, synthetic construct
  REGION 1..391: note = derived and/or modified protein sequence (wt) from HRSV__AFM55283.1__N
MALSKVKLNDTLNKDQLLSSSKYTIQRSTGDSIDTPNYDVQKHINKLCGMLLITEDANHKFTGIIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10525 - protein, 391 aa, synthetic construct
  REGION 1..391: note = derived and/or modified protein sequence (wt) from HRSV__AFM55514.1__N
MALSKVKLNDTLNKDHLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNVMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10526 - protein, 391 aa, synthetic construct
  REGION 1..391: note = derived and/or modified protein sequence (wt) from HRSV__AFM55547.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10527 - protein, 391 aa, synthetic construct
  REGION 1..391: note = derived and/or modified protein sequence (wt) from HRSV__AFM95360.1__N
MALSKVKLNDTLNKDQLLSSSKYTIQRSTGDSIDTPNYDVQKHINKLCGMLLITEDANHKFTGLIGMLYAMSRLGREDTIKILKDAGYHIKANGVDITTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10528 - protein, 391 aa, synthetic construct
  REGION 1..391: note = derived and/or modified protein sequence (wt) from HRSV__AFX95846.1__N
MAPSKVKLNDTLNKDQPPSSSKYTIQRSTGDSTDTPNYDVQKHTNKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10529 - protein, 391 aa, synthetic construct
  REGION 1..391: note = derived and/or modified protein sequence (wt) from HRSV__AGN28666.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNETKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10530 - protein, 391 aa, synthetic construct
  REGION 1..391: note = derived and/or modified protein sequence (wt) from HRSV__AGN28787.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLLPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10531 - protein, 391 aa, synthetic construct
  REGION 1..391: note = derived and/or modified protein sequence (wt) from HRSV__AGT75341.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKYEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10532 - protein, 391 aa, synthetic construct
  REGION 1..391: note = derived and/or modified protein sequence (wt) from HRSV__AHA83645.1__N
MALSKVKLNDTLNKDQLLSSSKYAIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10533 - protein, 391 aa, synthetic construct
  REGION 1..391: note = derived and/or modified protein sequence (wt) from HRSV__AHA83744.1__N
MALSKVKLNDTLNKDQLLSSSKYTIQRSTGDNIDTPNYDVQKHLNKLCGMLLITEDTNHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10534 - protein, 391 aa, synthetic construct
  REGION 1..391: note = derived and/or modified protein sequence (wt) from HRSV__AHA83919.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLILSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10535 - protein, 391 aa, synthetic construct
  REGION 1..391: note = derived and/or modified protein sequence (wt) from HRSV__AHB33450.1__N
MALSKVKLNDTLNKDQLLSFSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10536 - protein, 391 aa, synthetic construct
  REGION 1..391: note = derived and/or modified protein sequence (wt) from HRSV__AHC94758.1__N
MALSKVKLNDTLNKDQLLSSSKYAIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10537 - protein, 391 aa, synthetic construct
  REGION 1..391: note = derived and/or modified protein sequence (wt) from HRSV__AHV80753.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVALEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEEDVEL

SEQ ID NO: 10538 - protein, 391 aa, synthetic construct
  REGION 1..391: note = derived and/or modified protein sequence (wt) from HRSV__AHV80798.1__N
MALSKVKLNDTLNKDQLLSSSKYTIQRSTGDNIDTPNYDVQKHLNKLCGMLLITEDANHKFTGLIGMLYAMSRLGREDTIKILRDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10539 - protein, 391 aa, synthetic construct
  REGION 1..391: note = derived and/or modified protein sequence (wt) from HRSV__AHV81073.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEEDVEL

SEQ ID NO: 10540 - protein, 391 aa, synthetic construct
  REGION 1..391: note = derived and/or modified protein sequence (wt) from HRSV__AHV81084.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHAGVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10541 - protein, 391 aa, synthetic construct
  REGION 1..391: note = derived and/or modified protein sequence (wt) from HRSV__AHV81237.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVALGNAAGLGIMGEYRGTPRNQDLYDAAKAYAEQLKENGVINYSVLDLTAEELEAIKHQLNPKDNDVEL

SEQ ID NO: 10542 - protein, 391 aa, synthetic construct
  REGION 1..391: note = derived and/or modified protein sequence (wt) from HRSV__AHV81292.1__N
MALSKVKLNDTLNKDQLLSSSKYTIQRSTGDSIDTPNYDVQKHINKLCGMLLITEDANHKFTGLIGMLYAMSRLGREDTIKILKDAGYHAKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10543 - protein, 391 aa, synthetic construct
  REGION 1..391: note = derived and/or modified protein sequence (wt) from HRSV__AHV81457.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEVESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10544 - protein, 391 aa, synthetic construct
  REGION 1..391: note = derived and/or modified protein sequence (wt) from HRSV__AHV81677.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVALEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10545 - protein, 391 aa, synthetic construct
  REGION 1..391: note = derived and/or modified protein sequence (wt) from HRSV__AHW80506.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMRFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10546 - protein, 391 aa, synthetic construct
  REGION 1..391: note = derived and/or modified protein sequence (wt) from HRSV__AHW80735.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEHRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10547 - protein, 391 aa, synthetic construct
  REGION 1..391: note = derived and/or modified protein sequence (wt) from HRSV__AHW80745.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEHRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELETIKHQLNPKDNDVEL

SEQ ID NO: 10548 - protein, 391 aa, synthetic construct
  REGION 1..391: note = derived and/or modified protein sequence (wt) from HRSV__AHW80795.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHLIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10549 - protein, 391 aa, synthetic construct
  REGION 1..391: note = derived and/or modified protein sequence (wt) from HRSV__AHW80935.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELETIKHQLNPKDNDVEL

SEQ ID NO: 10550 - protein, 391 aa, synthetic construct
  REGION 1..391: note = derived and/or modified protein sequence (wt) from HRSV__AHW81055.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLAAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10551 - protein, 391 aa, synthetic construct
  REGION 1..391: note = derived and/or modified protein sequence (wt) from HRSV__AHW81295.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVKKNKMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10552 - protein, 391 aa, synthetic construct
  REGION 1..391: note = derived and/or modified protein sequence (wt) from HRSV__AHX57191.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYARKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10553 - protein, 391 aa, synthetic construct
  REGION 1..391: note = derived and/or modified protein sequence (wt) from HRSV__AHX57554.1__N
MALSKVKLNDTINKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10554 - protein, 391 aa, synthetic construct
  REGION 1..391: note = derived and/or modified protein sequence (wt) from HRSV__AHY21293.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQIVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10555 - protein, 391 aa, synthetic construct
  REGION 1..391: note = derived and/or modified protein sequence (wt) from HRSV__AHY21326.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQANIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10556 - protein, 391 aa, synthetic construct
  REGION 1..391: note = derived and/or modified protein sequence (wt) from HRSV__AHY21392.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIATSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10557 - protein, 391 aa, synthetic construct
  REGION 1..391: note = derived and/or modified protein sequence (wt) from HRSV__AHY21425.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTIHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHLIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10558 - protein, 391 aa, synthetic construct
  REGION 1..391: note = derived and/or modified protein sequence (wt) from HRSV__AIA62740.1__N
MALSKVKLNDTLNKDQLLSSSKYTIQRSTGDSIDTPNYDVQKHINNLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10559 - protein, 391 aa, synthetic construct
  REGION 1..391: note = derived and/or modified protein sequence (wt) from HRSV__AIA62979.1__N
MALSKVKLNDTLNKEHLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10560 - protein, 388 aa, synthetic construct
  REGION 1..388: note = derived and/or modified protein sequence (wt) from HRSV__AIA63399.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLIFLTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10561 - protein, 391 aa, synthetic construct
  REGION 1..391: note = derived and/or modified protein sequence (wt) from HRSV__AIY62423.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10562 - protein, 391 aa, synthetic construct
  REGION 1..391: note = derived and/or modified protein sequence (wt) from HRSV__AIY70193.1__N
MALSKVKLNDTLNKDQLLSSSKYTIQRSTGDGIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10563 - protein, 391 aa, synthetic construct
  REGION 1..391: note = derived and/or modified protein sequence (wt) from HRSV__AIZ95602.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMTILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10564 - protein, 391 aa, synthetic construct
  REGION 1..391: note = derived and/or modified protein sequence (wt) from HRSV__AIZ95624.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10565 - protein, 391 aa, synthetic construct
  REGION 1..391: note = derived and/or modified protein sequence (wt) from HRSV__AIZ95646.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLKPKDNDVEL

SEQ ID NO: 10566 - protein, 391 aa, synthetic construct
  REGION 1..391: note = derived and/or modified protein sequence (wt) from HRSV__AIZ95866.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLTSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10567 - protein, 391 aa, synthetic construct
  REGION 1..391: note = derived and/or modified protein sequence (wt) from HRSV__AIZ95943.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIATSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHLLNPKEDDVEL

SEQ ID NO: 10568 - protein, 390 aa, synthetic construct
  REGION 1..390: note = derived and/or modified protein sequence (wt) from HRSV__AJF44633.1__N
MALSKVKLNDTLKDQLLSSSKYTIQRSTGDSIDTPNYDVQKHINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10569 - protein, 391 aa, synthetic construct
  REGION 1..391: note = derived and/or modified protein sequence (wt) from HRSV__AJF44638.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDVTTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10570 - protein, 391 aa, synthetic construct
  REGION 1..391: note = derived and/or modified protein sequence (wt) from HRSV__AJF44733.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLTSLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10571 - protein, 391 aa, synthetic construct
  REGION 1..391: note = derived and/or modified protein sequence (wt) from HRSV__AJO16072.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCVAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNVMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10572 - protein, 391 aa, synthetic construct
  REGION 1..391: note = derived and/or modified protein sequence (wt) from HRSV__AJZ69864.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDVTTHRHDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10573 - protein, 391 aa, synthetic construct
  REGION 1..391: note = derived and/or modified protein sequence (wt) from HRSV__AJZ69875.1__N
MALSKVKLNDTLNKDQLLSSSKYTIQRSTGDNIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10574 - protein, 391 aa, synthetic construct
  REGION 1..391: note = derived and/or modified protein sequence (wt) from HRSV__AJZ70062.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFDVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10575 - protein, 391 aa, synthetic construct
  REGION 1..391: note = derived and/or modified protein sequence (wt) from HRSV__AKA45811.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMDQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10576 - protein, 391 aa, synthetic construct
  REGION 1..391: note = derived and/or modified protein sequence (wt) from HRSV__AMA66531.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGAINYSVLDLTAEELEAIKHQLNPKEDDVEL

SEQ ID NO: 10577 - protein, 391 aa, synthetic construct
  REGION 1..391: note = derived and/or modified protein sequence (wt) from HRSV__AMA66564.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKASGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10578 - protein, 391 aa, synthetic construct
  REGION 1..391: note = derived and/or modified protein sequence (wt) from HRSV__AMA66575.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVATHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10579 - protein, 391 aa, synthetic construct
  REGION 1..391: note = derived and/or modified protein sequence (wt) from HRSV__AMA66619.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKLEVLTLSSLTSEIQANIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10580 - protein, 391 aa, synthetic construct
  REGION 1..391: note = derived and/or modified protein sequence (wt) from HRSV__AMA66806.1__N
MALSKVKLNDTLNKDQLLSSSKYTIQRSTGDSIDTPNYDVQKNINKLCGMLLITEDANHKFTGVIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10581 - protein, 391 aa, synthetic construct
  REGION 1..391: note = derived and/or modified protein sequence (wt) from HRSV__AMA66817.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQEINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10582 - protein, 391 aa, synthetic construct
  REGION 1..391: note = derived and/or modified protein sequence (wt) from HRSV__AMA67092.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCMAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10583 - protein, 391 aa, synthetic construct
  REGION 1..391: note = derived and/or modified protein sequence (wt) from HRSV__AMA67235.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGITAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10584 - protein, 391 aa, synthetic construct
  REGION 1..391: note = derived and/or modified protein sequence (wt) from HRSV__AMA67323.1__N
MALSKVKLNDTLNKDQLLSSSKYTIQRSTGDSIDTPNYDVQKHINKLCGMLLITEDANHKFTGVIGMLYAMSRLGREDTIKILRDAGYHVKANGVDITTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10585 - protein, 391 aa, synthetic construct
  REGION 1..391: note = derived and/or modified protein sequence (wt) from HRSV__AMA67334.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDMNGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKNQLNPKEDDVEL

SEQ ID NO: 10586 - protein, 391 aa, synthetic construct
  REGION 1..391: note = derived and/or modified protein sequence (wt) from HRSV__AMN91424.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRRSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10587 - protein, 391 aa, synthetic construct
  REGION 1..391: note = derived and/or modified protein sequence (wt) from HRSV__AMT77353.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIASSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10588 - protein, 391 aa, synthetic construct
  REGION 1..391: note = derived and/or modified protein sequence (wt) from HRSV__AMT77518.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGITAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10589 - protein, 391 aa, synthetic construct
  REGION 1..391: note = derived and/or modified protein sequence (wt) from HRSV__AMT77639.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVTPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10590 - protein, 391 aa, synthetic construct
  REGION 1..391: note = derived and/or modified protein sequence (wt) from HRSV__AMT77727.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVNRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10591 - protein, 391 aa, synthetic construct
  REGION 1..391: note = derived and/or modified protein sequence (wt) from HRSV__AMT78035.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKASGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10592 - protein, 391 aa, synthetic construct
  REGION 1..391: note = derived and/or modified protein sequence (wt) from HRSV__AMT78068.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELETIKHQLNPKDNDVEL

SEQ ID NO: 10593 - protein, 391 aa, synthetic construct
  REGION 1..391: note = derived and/or modified protein sequence (wt) from HRSV__AMT78431.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIMLCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10594 - protein, 391 aa, synthetic construct
  REGION 1..391: note = derived and/or modified protein sequence (wt) from HRSV__AMT79185.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEHRGTPRNQDLYDAAKAYAEQLKENGVINYSVLDLTAEELEAIKHQLNPKDNDVEL

SEQ ID NO: 10595 - protein, 391 aa, synthetic construct
  REGION 1..391: note = derived and/or modified protein sequence (wt) from HRSV__AMT79262.1__N
MALSKVRLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10596 - protein, 391 aa, synthetic construct
  REGION 1..391: note = derived and/or modified protein sequence (wt) from HRSV__AMT79383.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQRLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10597 - protein, 391 aa, synthetic construct
  REGION 1..391: note = derived and/or modified protein sequence (wt) from HRSV__AMT79592.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVITHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFGKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10598 - protein, 391 aa, synthetic construct
  REGION 1..391: note = derived and/or modified protein sequence (wt) from HRSV__ANZ80095.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTAEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10599 - protein, 391 aa, synthetic construct
  REGION 1..391: note = derived and/or modified protein sequence (wt) from HRSV__ANZ80414.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFDKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10600 - protein, 391 aa, synthetic construct
  REGION 1..391: note = derived and/or modified protein sequence (wt) from HRSV__AOS48678.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTHRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10601 - protein, 391 aa, synthetic construct
  REGION 1..391: note = derived and/or modified protein sequence (wt) from HRSV__AOS48711.1__N
MALSKVKLNDTLNKDQLLSSSKYTIQRSTGDSIDTPNYDVQKHINKLCGMLLITEDANHKFTGVVGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10602 - protein, 391 aa, synthetic construct
  REGION 1..391: note = derived and/or modified protein sequence (wt) from HRSV__AOS48854.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAVKHQLNPKDNDVEL

SEQ ID NO: 10603 - protein, 391 aa, synthetic construct
  REGION 1..391: note = derived and/or modified protein sequence (wt) from HRSV__AOS49151.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITIYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10604 - protein, 391 aa, synthetic construct
  REGION 1..391: note = derived and/or modified protein sequence (wt) from HRSV__AOS49173.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEVESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10605 - protein, 391 aa, synthetic construct
  REGION 1..391: note = derived and/or modified protein sequence (wt) from HRSV__APW78620.1__N
MALSKVKLNDTLNKDQLLSSSKYTIQRSTGDNIDTPNYDVQKHLNKLCGMLLITEDANHKFTGLIGMLYVMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10606 - protein, 391 aa, synthetic construct
  REGION 1..391: note = derived and/or modified protein sequence (wt) from HRSV__APW78631.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNELKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10607 - protein, 391 aa, synthetic construct
  REGION 1..391: note = derived and/or modified protein sequence (wt) from HRSV__APW78697.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYRGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGITGEYRGTPRNQDLYDAAKAYAEQLKENGVINYSVLDLTTEELEAIKHQLNPKEDDVEL

SEQ ID NO: 10608 - protein, 391 aa, synthetic construct
  REGION 1..391: note = derived and/or modified protein sequence (wt) from HRSV__APW78763.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKEDDVEL

SEQ ID NO: 10609 - protein, 391 aa, synthetic construct
  REGION 1..391: note = derived and/or modified protein sequence (wt) from HRSV__APW78829.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYKGTPRNQDLYDAAKAYAEQLKENGVINYSVLDLTTEELEAIKHQLNPKEDDVEL

SEQ ID NO: 10610 - protein, 391 aa, synthetic construct
  REGION 1..391: note = derived and/or modified protein sequence (wt) from HRSV__APW78884.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDVNGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10611 - protein, 391 aa, synthetic construct
  REGION 1..391: note = derived and/or modified protein sequence (wt) from HRSV__APW78895.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKENDVEL

SEQ ID NO: 10612 - protein, 389 aa, synthetic construct
  REGION 1..389: note = derived and/or modified protein sequence (wt) from HRSV__AQX36836.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDM

SEQ ID NO: 10613 - protein, 391 aa, synthetic construct
  REGION 1..391: note = derived and/or modified protein sequence (wt) from HRSV__ARB66400.1__N
MALSKVKLNDTLNKDQLLSSSKYTIQRSTGDSIDTPNYDVQKHINKLWGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10614 - protein, 391 aa, synthetic construct
  REGION 1..391: note = derived and/or modified protein sequence (wt) from HRSV__ARB66422.1__N
MAPSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10615 - protein, 391 aa, synthetic construct
  REGION 1..391: note = derived and/or modified protein sequence (wt) from HRSV__ARR29184.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEIKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10616 - protein, 391 aa, synthetic construct
  REGION 1..391: note = derived and/or modified protein sequence (wt) from HRSV__ARR29246.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNVMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10617 - protein, 391 aa, synthetic construct
  REGION 1..391: note = derived and/or modified protein sequence (wt) from HRSV__ART28302.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQISIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10618 - protein, 391 aa, synthetic construct
  REGION 1..391: note = derived and/or modified protein sequence (wt) from HRSV__ART28389.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYRGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10619 - protein, 391 aa, synthetic construct
  REGION 1..391: note = derived and/or modified protein sequence (wt) from HRSV__ASK05515.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKEDDVEL

SEQ ID NO: 10620 - protein, 391 aa, synthetic construct
  REGION 1..391: note = derived and/or modified protein sequence (wt) from HRSV__ASV49527.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAINHQLNPKDNDVEL

SEQ ID NO: 10621 - protein, 391 aa, synthetic construct
  REGION 1..391: note = derived and/or modified protein sequence (wt) from HRSV__ASV65822.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTSEELEAIKHQLNPKDNDVEL

SEQ ID NO: 10622 - protein, 391 aa, synthetic construct
  REGION 1..391: note = derived and/or modified protein sequence (wt) from HRSV__ASZ70094.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKDMKFEVLTLTSLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10623 - protein, 391 aa, synthetic construct
  REGION 1..391: note = derived and/or modified protein sequence (wt) from HRSV__AUC68067.1__N
MALSKVKLNDTLNKDQLLSSSKYTIQRSTGDSIDTPNYDVQKHINKLCGMLLITEDANHKFTGLIGMLYAMSRLGREDTIKILKDAGYHVKANGVDVTTHRQDINGKEMKFEVLTLASLTTEIQINIEIESRKSYKKMLKEMGEVAPEYRHDSPDCGMIILCIAALVITKLAAGDRSGLIAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10624 - protein, 391 aa, synthetic construct
  REGION 1..391: note = derived and/or modified protein sequence (wt) from HRSV__AUC68089.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNTAGLGIMGEYRGTPRNQDLYDAAKAYAEQLKENGVINYSVLDLTAEELEAIKHQLNPKDNDVEL

SEQ ID NO: 10625 - protein, 391 aa, synthetic construct
  REGION 1..391: note = derived and/or modified protein sequence (wt) from HRSV__AUC68221.1__N
MALSKVKLNDTLNKDQLLSSSKYTIQRSTGDNIDTPNYDVQKHLNKLCGMLLITDDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKNQLNPKEDDVEL

SEQ ID NO: 10626 - protein, 391 aa, synthetic construct
  REGION 1..391: note = derived and/or modified protein sequence (wt) from HRSV__AUC68473.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIASSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKNQLNPKEDDVEL

SEQ ID NO: 10627 - protein, 391 aa, synthetic construct
  REGION 1..391: note = derived and/or modified protein sequence (wt) from HRSV__AUH15159.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFDVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10628 - protein, 391 aa, synthetic construct
  REGION 1..391: note = derived and/or modified protein sequence (wt) from HRSV__BAE96916.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPRDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10629 - protein, 391 aa, synthetic construct
  REGION 1..391: note = derived and/or modified protein sequence (wt) from HRSV__BBA57885.1__N
MALSKVKLNDTLNKDQLLSSSKYTIQRSTGDNIDTPNYDVQKHLNKLCGMLLITEDANHKFTGLVGMLYAMSRLGREDTIKILKDAGYHVKANGVDITTYRQDINGKEMKFEVLTLSSLTSEIQVNIEIESRKSYKKMLKEMGEVAPEYRHDSPDCGMIILCIAALVITKLAAGDRSGLTAVIRRANNVLKNEIKRYKGLIPKDIANSFYEVFEKYPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKHQLNPKEDDVEL

SEQ ID NO: 10630 - protein, 391 aa, synthetic construct
  REGION 1..391: note = derived and/or modified protein sequence (wt) from HRSV__CAI96788.1__N
MALSKVKLNDTFNKDQLLSTSKYTIQRSTGDNIDIPNYDVQKHLNKLCGMLLITEDANHKFTGLIGMLYAMSRLGREDTLKILKDAGYQVRANGVDVITHRQDVNGKEMKFEVLTLVSLTSEVQGNIEIESRKSYKKMLKEMGEVAPEFRHDSPDCGMIVLCVAALVITKLAAGDRSGLTAVIRRANNVLRNEMKRYKGLIPKDIANSFYEVFEKYPHYIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKDNDVGS

SEQ ID NO: 10631 - protein, 391 aa, synthetic construct
  REGION 1..391: note = derived and/or modified protein sequence (wt) from HRSV__NP_044591.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLSSLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKYPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10632 - protein, 391 aa, synthetic construct
  REGION 1..391: note = derived and/or modified protein sequence (wt) from HRSV__P22677.1__N
MALSKVKLNDTFNKDQLLSTSKYTIQRSTGDNIDIPNYDVQKHLNKLCGMLLITEDANHKFTGLIGILYAMSRLGREDTLKILKDAGYQVRANGVDVITHRQDVNGKEMKFEVLTLVSLTSEVQGNIEIESRKSYKKMLKEMGEVAPEYRHDSPDCGMIVLCVAALVITKLAAGDRSGLTAVIRRANNVLRNEMKRYKGLIPKDIANSFYEVIEKYPHYIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKDNDVEL

SEQ ID NO: 10633 - protein, 391 aa, synthetic construct
  REGION 1..391: note = derived and/or modified protein sequence (wt) from HRSV__P24566.1__N
MALSKVKLNDTLNKDQLLSSSKYTIQRSTGDNIDTPNYDVQKHLNKLCGMLLITEDANHKFTGLIGMLYAMSRLGREDTIKILKDAGYHVKANGVDITTYRQDINGKEMKFEVLTLSSLTSEIQVNIEIESRKSYKKLLKEMGEVAPEYRHDSPDCGMIILCIAALVITKLAAGDRSGLTAVIRRANNVLKNEIKRYKGLIPKDIANSFYEVFEKHPHLIDVFVHFGIAQSSTRGGSRVEGIFAGLFMNAYGSGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTAEELEAIKHQLNPKEDDVEL

SEQ ID NO: 10634 - protein, 393 aa, synthetic construct
  REGION 1..393: note = derived and/or modified protein sequence (wt) from HRSV__P26589.1__N
MSLDRLKLNDVSNKDSLLSNCKYSVTRSTGDVTSVSGHAMQKALARTLGMFLLTAFNRCEEVAEIGLQYAMSLLGRDDSIKILREAGYNVKCVDTQLKDFTIKLQGKEYKIQVLDIVGIDAANLADLEIQARGVVAKELKTGARLPDNRRHDAPDCGVIVLCIAALVVSKLAAGDRGGLDAVERRALNVLKAEKARYPNMEVKQIAESFYDLFERKPYYIDVFITFGLAQSSVRGGSKVEGLFSGLFMNAYGAGQVMLRWGLLAKSVKNIMLGHASVQAEMEQVVEVYEYAQKQGGEAGFYHIRNNPKASLLSLTNCPNFTSVVLGNAAGLGIIGSYKGAPRNRELFDAAKDYAERLKDNNVINYSALNLTAEERELISQQLNIVDDTPDDDI

SEQ ID NO: 10635 - protein, 391 aa, synthetic construct
  REGION 1..391: note = derived and/or modified protein sequence (wt) from HRSV__P35943.1__N
MALSKVKLNDTFNKDQLLSTSKYTIQRSTGDNIDIPNYDVQKHLNKLCGMLLITEDANHKFTGLIGMLYAMSRLGREDTLKILKDAGYQVRANGVDVITHRQDVNGKEMKFEVLTLVSLTSEVQGNIEIESRKSYKKMLKEMGEVAPEYRHDFPDCGMIVLCVAALVITKLAAGDRSGLTAVIRRANNVLRNEMKRYKGLIPKDIANSFYEVFEKYPHYIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKDNDVEL

SEQ ID NO: 10636 - protein, 391 aa, synthetic construct
  REGION 1..391: note = derived and/or modified protein sequence (wt) from HRSV__Q83957.1__N
MALSKVKLNDTFNKDQLLSTSKYTIQRSTGDNIDIPNYDVQKHLNKLCGMLLITEDANHKFTGLIGMLYAMSRLGREDTLKILKDAGYQVKANGVDVITHRQDVNGKEMKFEVLTLVSLTSEVQVNIEVESRKSYKKMLKEMGEVAPEYRHDSPDCGMIVLCIAALVIAKLAAGDRSGLTAVIRRANNVLKNEIERYKGLIPKDVANSFYEVFEKYPHYIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKDNDVEL

SEQ ID NO: 10637 - protein, 241 aa, synthetic construct
  REGION 1..241: note = derived and/or modified protein sequence (wt) from HRSV(A2)__P03421.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMIGLREEMIEKIRTEALMTNDRLEAMARLRNEESEKMAKDTSDEVSLNPTSEKLNNLLEGNDSDNDLSLEDF

SEQ ID NO: 10638 - RNA, 726 nt, synthetic construct
  misc_feature 1..726: note = derived and/or modified CDS sequence (wt) from HRSV(A2)__P03421.1__P
  source 1..726: mol_type = other RNA
atggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctga

SEQ ID NO: 10639 - RNA, 726 nt, synthetic construct
  misc_feature 1..726: note = derived and/or modified CDS sequence (opt1) from HRSV(A2)__P03421.1__P
  source 1..726: mol_type = other RNA
atggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctga

SEQ ID NO: 10640 - RNA, 726 nt, synthetic construct
  misc_feature 1..726: note = derived and/or modified CDS sequence (opt2) from HRSV(A2)__P03421.1__P
  source 1..726: mol_type = other RNA
atggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctga

SEQ ID NO: 10641 - RNA, 726 nt, synthetic construct
  misc_feature 1..726: note = derived and/or modified CDS sequence (opt3) from HRSV(A2)__P03421.1__P
  source 1..726: mol_type = other RNA
atggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttga

SEQ ID NO: 10642 - RNA, 726 nt, synthetic construct
  misc_feature 1..726: note = derived and/or modified CDS sequence (opt4) from HRSV(A2)__P03421.1__P
  source 1..726: mol_type = other RNA
atggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctga

SEQ ID NO: 10643 - RNA, 726 nt, synthetic construct
  misc_feature 1..726: note = derived and/or modified CDS sequence (opt5) from HRSV(A2)__P03421.1__P
  source 1..726: mol_type = other RNA
atggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttga

SEQ ID NO: 10644 - RNA, 726 nt, synthetic construct
  misc_feature 1..726: note = derived and/or modified CDS sequence (opt6) from HRSV(A2)__P03421.1__P
  source 1..726: mol_type = other RNA
atggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaa

SEQ ID NO: 10645 - RNA, 726 nt, synthetic construct
  misc_feature 1..726: note = derived and/or modified CDS sequence (opt11) from HRSV(A2)__P03421.1__P
  source 1..726: mol_type = other RNA
atggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctga

SEQ ID NO: 10646 - RNA, 1002 nt, synthetic construct
  misc_feature 1..1002: note = mRNA product Design a-1 comprising derived and/or modified sequence from HRSV(A2)__P03421.1__P (wt)
  source 1..1002: mol_type = other RNA
gggagagtcccgcagtcggcgtccagcggctctgcttgttcgtgtgtgtgtcgttgcaggccttattcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10647 - RNA, 1002 nt, synthetic construct
  misc_feature 1..1002: note = mRNA product Design a-1 comprising derived and/or modified sequence from HRSV(A2)__P03421.1__P (opt1)
  source 1..1002: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10648 - RNA, 1002 nt, synthetic construct
  misc_feature 1..1002: note = mRNA product Design a-1 comprising derived and/or modified sequence from HRSV(A2)__P03421.1__P (opt2)
  source 1..1002: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10649 - RNA, 1002 nt, synthetic construct
  misc_feature 1..1002: note = mRNA product Design a-1 comprising derived and/or modified sequence from HRSV(A2)__P03421.1__P (opt3)
  source 1..1002: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10650 - RNA, 1002 nt, synthetic construct
  misc_feature 1..1002: note = mRNA product Design a-1 comprising derived and/or modified sequence from HRSV(A2)__P03421.1__P (opt4)
  source 1..1002: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10651 - RNA, 1002 nt, synthetic construct
  misc_feature 1..1002: note = mRNA product Design a-1 comprising derived and/or modified sequence from HRSV(A2)__P03421.1__P (opt5)
  source 1..1002: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10652 - RNA, 1002 nt, synthetic construct
  misc_feature 1..1002: note = mRNA product Design a-1 comprising derived and/or modified sequence from HRSV(A2)__P03421.1__P (opt6)
  source 1..1002: mol_type = other RNA
gggagagtcccgcagtcggcgtccagcggctctgcttgttcgtgtgtgtgtcgttgcaggccttattcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10653 - RNA, 1002 nt, synthetic construct
  misc_feature 1..1002: note = mRNA product Design a-1 comprising derived and/or modified sequence from HRSV(A2)__P03421.1__P (opt11)
  source 1..1002: mol_type = other RNA
gggagagtcccgcagtcggcgtccagcggctctgcttgttcgtgtgtgtgtcgttgcaggccttattcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10654 - RNA, 1021 nt, synthetic construct
  misc_feature 1..1021: note = mRNA product Design a-2 comprising derived and/or modified sequence from HRSV(A2)__P03421.1__P (wt)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10655 - RNA, 1021 nt, synthetic construct
  misc_feature 1..1021: note = mRNA product Design a-2 comprising derived and/or modified sequence from HRSV(A2)__P03421.1__P (opt1)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10656 - RNA, 1021 nt, synthetic construct
  misc_feature 1..1021: note = mRNA product Design a-2 comprising derived and/or modified sequence from HRSV(A2)__P03421.1__P (opt2)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10657 - RNA, 1021 nt, synthetic construct
  misc_feature 1..1021: note = mRNA product Design a-2 comprising derived and/or modified sequence from HRSV(A2)__P03421.1__P (opt3)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10658 - RNA, 1021 nt, synthetic construct
  misc_feature 1..1021: note = mRNA product Design a-2 comprising derived and/or modified sequence from HRSV(A2)__P03421.1__P (opt4)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10659 - RNA, 1021 nt, synthetic construct
  misc_feature 1..1021: note = mRNA product Design a-2 comprising derived and/or modified sequence from HRSV(A2)__P03421.1__P (opt5)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10660 - RNA, 1021 nt, synthetic construct
  misc_feature 1..1021: note = mRNA product Design a-2 comprising derived and/or modified sequence from HRSV(A2)__P03421.1__P (opt6)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10661 - RNA, 1021 nt, synthetic construct
  misc_feature 1..1021: note = mRNA product Design a-2 comprising derived and/or modified sequence from HRSV(A2)__P03421.1__P (opt11)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10662 - RNA, 1099 nt, synthetic construct
  misc_feature 1..1099: note = mRNA product Design a-3 comprising derived and/or modified sequence from HRSV(A2)__P03421.1__P (wt)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10663 - RNA, 1099 nt, synthetic construct
  misc_feature 1..1099: note = mRNA product Design a-3 comprising derived and/or modified sequence from HRSV(A2)__P03421.1__P (opt1)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10664 - RNA, 1099 nt, synthetic construct
  misc_feature 1..1099: note = mRNA product Design a-3 comprising derived and/or modified sequence from HRSV(A2)__P03421.1__P (opt2)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10665 - RNA, 1099 nt, synthetic construct
  misc_feature 1..1099: note = mRNA product Design a-3 comprising derived and/or modified sequence from HRSV(A2)__P03421.1__P (opt3)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10666 - RNA, 1099 nt, synthetic construct
  misc_feature 1..1099: note = mRNA product Design a-3 comprising derived and/or modified sequence from HRSV(A2)__P03421.1__P (opt4)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10667 - RNA, 1099 nt, synthetic construct
  misc_feature 1..1099: note = mRNA product Design a-3 comprising derived and/or modified sequence from HRSV(A2)__P03421.1__P (opt5)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10668 - RNA, 1099 nt, synthetic construct
  misc_feature 1..1099: note = mRNA product Design a-3 comprising derived and/or modified sequence from HRSV(A2)__P03421.1__P (opt6)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10669 - RNA, 1099 nt, synthetic construct
  misc_feature 1..1099: note = mRNA product Design a-3 comprising derived and/or modified sequence from HRSV(A2)__P03421.1__P (opt11)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10670 - RNA, 1048 nt, synthetic construct
  misc_feature 1..1048: note = mRNA product Design a-4 comprising derived and/or modified sequence from HRSV(A2)__P03421.1__P (wt)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10671 - RNA, 1048 nt, synthetic construct
  misc_feature 1..1048: note = mRNA product Design a-4 comprising derived and/or modified sequence from HRSV(A2)__P03421.1__P (opt1)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10672 - RNA, 1048 nt, synthetic construct
  misc_feature 1..1048: note = mRNA product Design a-4 comprising derived and/or modified sequence from HRSV(A2)__P03421.1__P (opt2)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10673 - RNA, 1048 nt, synthetic construct
  misc_feature 1..1048: note = mRNA product Design a-4 comprising derived and/or modified sequence from HRSV(A2)__P03421.1__P (opt3)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10674 - RNA, 1048 nt, synthetic construct
  misc_feature 1..1048: note = mRNA product Design a-4 comprising derived and/or modified sequence from HRSV(A2)__P03421.1__P (opt4)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10675 - RNA, 1048 nt, synthetic construct
  misc_feature 1..1048: note = mRNA product Design a-4 comprising derived and/or modified sequence from HRSV(A2)__P03421.1__P (opt5)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10676 - RNA, 1048 nt, synthetic construct
  misc_feature 1..1048: note = mRNA product Design a-4 comprising derived and/or modified sequence from HRSV(A2)__P03421.1__P (opt6)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10677 - RNA, 1048 nt, synthetic construct
  misc_feature 1..1048: note = mRNA product Design a-4 comprising derived and/or modified sequence from HRSV(A2)__P03421.1__P (opt11)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10678 - RNA, 994 nt, synthetic construct
  misc_feature 1..994: note = mRNA product Design a-5 comprising derived and/or modified sequence from HRSV(A2)__P03421.1__P (wt)
  source 1..994: mol_type = other RNA
gggagactttcccattctgtagcagaatttggtgttgcctgtggtcttggtcccgcggagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10679 - RNA, 994 nt, synthetic construct
  misc_feature 1..994: note = mRNA product Design a-5 comprising derived and/or modified sequence from HRSV(A2)__P03421.1__P (opt1)
  source 1..994: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10680 - RNA, 994 nt, synthetic construct
  misc_feature 1..994: note = mRNA product Design a-5 comprising derived and/or modified sequence from HRSV(A2)__P03421.1__P (opt2)
  source 1..994: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10681 - RNA, 994 nt, synthetic construct
  misc_feature 1..994: note = mRNA product Design a-5 comprising derived and/or modified sequence from HRSV(A2)__P03421.1__P (opt3)
  source 1..994: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10682 - RNA, 994 nt, synthetic construct
  misc_feature 1..994: note = mRNA product Design a-5 comprising derived and/or modified sequence from HRSV(A2)__P03421.1__P (opt4)
  source 1..994: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10683 - RNA, 994 nt, synthetic construct
  misc_feature 1..994: note = mRNA product Design a-5 comprising derived and/or modified sequence from HRSV(A2)__P03421.1__P (opt5)
  source 1..994: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10684 - RNA, 994 nt, synthetic construct
  misc_feature 1..994: note = mRNA product Design a-5 comprising derived and/or modified sequence from HRSV(A2)__P03421.1__P (opt6)
  source 1..994: mol_type = other RNA
gggagactttcccattctgtagcagaatttggtgttgcctgtggtcttggtcccgcggagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10685 - RNA, 994 nt, synthetic construct
  misc_feature 1..994: note = mRNA product Design a-5 comprising derived and/or modified sequence from HRSV(A2)__P03421.1__P (opt11)
  source 1..994: mol_type = other RNA
gggagactttcccattctgtagcagaatttggtgttgcctgtggtcttggtcccgcggagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10686 - RNA, 1175 nt, synthetic construct
  misc_feature 1..1175: note = mRNA product Design b-1 comprising derived and/or modified sequence from HRSV(A2)__P03421.1__P (wt)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10687 - RNA, 1175 nt, synthetic construct
  misc_feature 1..1175: note = mRNA product Design b-1 comprising derived and/or modified sequence from HRSV(A2)__P03421.1__P (opt1)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10688 - RNA, 1175 nt, synthetic construct
  misc_feature 1..1175: note = mRNA product Design b-1 comprising derived and/or modified sequence from HRSV(A2)__P03421.1__P (opt2)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10689 - RNA, 1175 nt, synthetic construct
  misc_feature 1..1175: note = mRNA product Design b-1 comprising derived and/or modified sequence from HRSV(A2)__P03421.1__P (opt3)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10690 - RNA, 1175 nt, synthetic construct
  misc_feature 1..1175: note = mRNA product Design b-1 comprising derived and/or modified sequence from HRSV(A2)__P03421.1__P (opt4)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10691 - RNA, 1175 nt, synthetic construct
  misc_feature 1..1175: note = mRNA product Design b-1 comprising derived and/or modified sequence from HRSV(A2)__P03421.1__P (opt5)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10692 - RNA, 1175 nt, synthetic construct
  misc_feature 1..1175: note = mRNA product Design b-1 comprising derived and/or modified sequence from HRSV(A2)__P03421.1__P (opt6)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10693 - RNA, 1175 nt, synthetic construct
  misc_feature 1..1175: note = mRNA product Design b-1 comprising derived and/or modified sequence from HRSV(A2)__P03421.1__P (opt11)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10694 - RNA, 995 nt, synthetic construct
  misc_feature 1..995: note = mRNA product Design b-2 comprising derived and/or modified sequence from HRSV(A2)__P03421.1__P (wt)
  source 1..995: mol_type = other RNA
gggagagcctctgctggagtccggggagtggcgttggctgctagagcgaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10695 - RNA, 995 nt, synthetic construct
  misc_feature 1..995: note = mRNA product Design b-2 comprising derived and/or modified sequence from HRSV(A2)__P03421.1__P (opt1)
  source 1..995: mol_type = other RNA
gggagagcctctgctggagtccggggagtggcgttggctgctagagcgaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10696 - RNA, 995 nt, synthetic construct
  misc_feature 1..995: note = mRNA product Design b-2 comprising derived and/or modified sequence from HRSV(A2)__P03421.1__P (opt2)
  source 1..995: mol_type = other RNA
gggagagcctctgctggagtccggggagtggcgttggctgctagagcgaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10697 - RNA, 995 nt, synthetic construct
  misc_feature 1..995: note = mRNA product Design b-2 comprising derived and/or modified sequence from HRSV(A2)__P03421.1__P (opt3)
  source 1..995: mol_type = other RNA
gggagagcctctgctggagtccggggagtggcgttggctgctagagcgaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10698 - RNA, 995 nt, synthetic construct
  misc_feature 1..995: note = mRNA product Design b-2 comprising derived and/or modified sequence from HRSV(A2)__P03421.1__P (opt4)
  source 1..995: mol_type = other RNA
gggagagcctctgctggagtccggggagtggcgttggctgctagagcgaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10699 - RNA, 995 nt, synthetic construct
  misc_feature 1..995: note = mRNA product Design b-2 comprising derived and/or modified sequence from HRSV(A2)__P03421.1__P (opt5)
  source 1..995: mol_type = other RNA
gggagagcctctgctggagtccggggagtggcgttggctgctagagcgaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10700 - RNA, 995 nt, synthetic construct
  misc_feature 1..995: note = mRNA product Design b-2 comprising derived and/or modified sequence from HRSV(A2)__P03421.1__P (opt6)
  source 1..995: mol_type = other RNA
gggagagcctctgctggagtccggggagtggcgttggctgctagagcgaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10701 - RNA, 995 nt, synthetic construct
  misc_feature 1..995: note = mRNA product Design b-2 comprising derived and/or modified sequence from HRSV(A2)__P03421.1__P (opt11)
  source 1..995: mol_type = other RNA
gggagagcctctgctggagtccggggagtggcgttggctgctagagcgaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10702 - RNA, 1015 nt, synthetic construct
  misc_feature 1..1015: note = mRNA product Design b-3 comprising derived and/or modified sequence from HRSV(A2)__P03421.1__P (wt)
  source 1..1015: mol_type = other RNA
gggagagtcccgcagtcggcgtccagcggctctgcttgttcgtgtgtgtgtcgttgcaggccttattcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10703 - RNA, 1015 nt, synthetic construct
  misc_feature 1..1015: note = mRNA product Design b-3 comprising derived and/or modified sequence from HRSV(A2)__P03421.1__P (opt1)
  source 1..1015: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10704 - RNA, 1015 nt, synthetic construct
  misc_feature 1..1015: note = mRNA product Design b-3 comprising derived and/or modified sequence from HRSV(A2)__P03421.1__P (opt2)
  source 1..1015: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10705 - RNA, 1015 nt, synthetic construct
  misc_feature 1..1015: note = mRNA product Design b-3 comprising derived and/or modified sequence from HRSV(A2)__P03421.1__P (opt3)
  source 1..1015: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10706 - RNA, 1015 nt, synthetic construct
  misc_feature 1..1015: note = mRNA product Design b-3 comprising derived and/or modified sequence from HRSV(A2)__P03421.1__P (opt4)
  source 1..1015: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10707 - RNA, 1015 nt, synthetic construct
  misc_feature 1..1015: note = mRNA product Design b-3 comprising derived and/or modified sequence from HRSV(A2)__P03421.1__P (opt5)
  source 1..1015: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10708 - RNA, 1015 nt, synthetic construct
  misc_feature 1..1015: note = mRNA product Design b-3 comprising derived and/or modified sequence from HRSV(A2)__P03421.1__P (opt6)
  source 1..1015: mol_type = other RNA
gggagagtcccgcagtcggcgtccagcggctctgcttgttcgtgtgtgtgtcgttgcaggccttattcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10709 - RNA, 1015 nt, synthetic construct
  misc_feature 1..1015: note = mRNA product Design b-3 comprising derived and/or modified sequence from HRSV(A2)__P03421.1__P (opt11)
  source 1..1015: mol_type = other RNA
gggagagtcccgcagtcggcgtccagcggctctgcttgttcgtgtgtgtgtcgttgcaggccttattcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10710 - RNA, 1066 nt, synthetic construct
  misc_feature 1..1066: note = mRNA product Design b-4 comprising derived and/or modified sequence from HRSV(A2)__P03421.1__P (wt)
  source 1..1066: mol_type = other RNA
gggagagtcccgcagtcggcgtccagcggctctgcttgttcgtgtgtgtgtcgttgcaggccttattcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10711 - RNA, 1066 nt, synthetic construct
  misc_feature 1..1066: note = mRNA product Design b-4 comprising derived and/or modified sequence from HRSV(A2)__P03421.1__P (opt1)
  source 1..1066: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10712 - RNA, 1066 nt, synthetic construct
  misc_feature 1..1066: note = mRNA product Design b-4 comprising derived and/or modified sequence from HRSV(A2)__P03421.1__P (opt2)
  source 1..1066: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10713 - RNA, 1066 nt, synthetic construct
  misc_feature 1..1066: note = mRNA product Design b-4 comprising derived and/or modified sequence from HRSV(A2)__P03421.1__P (opt3)
  source 1..1066: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10714 - RNA, 1066 nt, synthetic construct
  misc_feature 1..1066: note = mRNA product Design b-4 comprising derived and/or modified sequence from HRSV(A2)__P03421.1__P (opt4)
  source 1..1066: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10715 - RNA, 1066 nt, synthetic construct
  misc_feature 1..1066: note = mRNA product Design b-4 comprising derived and/or modified sequence from HRSV(A2)__P03421.1__P (opt5)
  source 1..1066: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10716 - RNA, 1066 nt, synthetic construct
  misc_feature 1..1066: note = mRNA product Design b-4 comprising derived and/or modified sequence from HRSV(A2)__P03421.1__P (opt6)
  source 1..1066: mol_type = other RNA
gggagagtcccgcagtcggcgtccagcggctctgcttgttcgtgtgtgtgtcgttgcaggccttattcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10717 - RNA, 1066 nt, synthetic construct
  misc_feature 1..1066: note = mRNA product Design b-4 comprising derived and/or modified sequence from HRSV(A2)__P03421.1__P (opt11)
  source 1..1066: mol_type = other RNA
gggagagtcccgcagtcggcgtccagcggctctgcttgttcgtgtgtgtgtcgttgcaggccttattcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10718 - RNA, 1128 nt, synthetic construct
  misc_feature 1..1128: note = mRNA product Design b-5 comprising derived and/or modified sequence from HRSV(A2)__P03421.1__P (wt)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10719 - RNA, 1128 nt, synthetic construct
  misc_feature 1..1128: note = mRNA product Design b-5 comprising derived and/or modified sequence from HRSV(A2)__P03421.1__P (opt1)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10720 - RNA, 1128 nt, synthetic construct
  misc_feature 1..1128: note = mRNA product Design b-5 comprising derived and/or modified sequence from HRSV(A2)__P03421.1__P (opt2)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10721 - RNA, 1128 nt, synthetic construct
  misc_feature 1..1128: note = mRNA product Design b-5 comprising derived and/or modified sequence from HRSV(A2)__P03421.1__P (opt3)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10722 - RNA, 1128 nt, synthetic construct
  misc_feature 1..1128: note = mRNA product Design b-5 comprising derived and/or modified sequence from HRSV(A2)__P03421.1__P (opt4)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10723 - RNA, 1128 nt, synthetic construct
  misc_feature 1..1128: note = mRNA product Design b-5 comprising derived and/or modified sequence from HRSV(A2)__P03421.1__P (opt5)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10724 - RNA, 1128 nt, synthetic construct
  misc_feature 1..1128: note = mRNA product Design b-5 comprising derived and/or modified sequence from HRSV(A2)__P03421.1__P (opt6)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10725 - RNA, 1128 nt, synthetic construct
  misc_feature 1..1128: note = mRNA product Design b-5 comprising derived and/or modified sequence from HRSV(A2)__P03421.1__P (opt11)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10726 - RNA, 1034 nt, synthetic construct
  misc_feature 1..1034: note = mRNA product Design c-1 comprising derived and/or modified sequence from HRSV(A2)__P03421.1__P (wt)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10727 - RNA, 1034 nt, synthetic construct
  misc_feature 1..1034: note = mRNA product Design c-1 comprising derived and/or modified sequence from HRSV(A2)__P03421.1__P (opt1)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10728 - RNA, 1034 nt, synthetic construct
  misc_feature 1..1034: note = mRNA product Design c-1 comprising derived and/or modified sequence from HRSV(A2)__P03421.1__P (opt2)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10729 - RNA, 1034 nt, synthetic construct
  misc_feature 1..1034: note = mRNA product Design c-1 comprising derived and/or modified sequence from HRSV(A2)__P03421.1__P (opt3)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10730 - RNA, 1034 nt, synthetic construct
  misc_feature 1..1034: note = mRNA product Design c-1 comprising derived and/or modified sequence from HRSV(A2)__P03421.1__P (opt4)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10731 - RNA, 1034 nt, synthetic construct
  misc_feature 1..1034: note = mRNA product Design c-1 comprising derived and/or modified sequence from HRSV(A2)__P03421.1__P (opt5)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10732 - RNA, 1034 nt, synthetic construct
  misc_feature 1..1034: note = mRNA product Design c-1 comprising derived and/or modified sequence from HRSV(A2)__P03421.1__P (opt6)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10733 - RNA, 1034 nt, synthetic construct
  misc_feature 1..1034: note = mRNA product Design c-1 comprising derived and/or modified sequence from HRSV(A2)__P03421.1__P (opt11)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10734 - RNA, 1124 nt, synthetic construct
  misc_feature 1..1124: note = mRNA product Design c-2 comprising derived and/or modified sequence from HRSV(A2)__P03421.1__P (wt)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10735 - RNA, 1124 nt, synthetic construct
  misc_feature 1..1124: note = mRNA product Design c-2 comprising derived and/or modified sequence from HRSV(A2)__P03421.1__P (opt1)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10736 - RNA, 1124 nt, synthetic construct
  misc_feature 1..1124: note = mRNA product Design c-2 comprising derived and/or modified sequence from HRSV(A2)__P03421.1__P (opt2)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10737 - RNA, 1124 nt, synthetic construct
  misc_feature 1..1124: note = mRNA product Design c-2 comprising derived and/or modified sequence from HRSV(A2)__P03421.1__P (opt3)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10738 - RNA, 1124 nt, synthetic construct
  misc_feature 1..1124: note = mRNA product Design c-2 comprising derived and/or modified sequence from HRSV(A2)__P03421.1__P (opt4)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10739 - RNA, 1124 nt, synthetic construct
  misc_feature 1..1124: note = mRNA product Design c-2 comprising derived and/or modified sequence from HRSV(A2)__P03421.1__P (opt5)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10740 - RNA, 1124 nt, synthetic construct
  misc_feature 1..1124: note = mRNA product Design c-2 comprising derived and/or modified sequence from HRSV(A2)__P03421.1__P (opt6)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10741 - RNA, 1124 nt, synthetic construct
  misc_feature 1..1124: note = mRNA product Design c-2 comprising derived and/or modified sequence from HRSV(A2)__P03421.1__P (opt11)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10742 - RNA, 1101 nt, synthetic construct
  misc_feature 1..1101: note = mRNA product Design c-3 comprising derived and/or modified sequence from HRSV(A2)__P03421.1__P (wt)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10743 - RNA, 1101 nt, synthetic construct
  misc_feature 1..1101: note = mRNA product Design c-3 comprising derived and/or modified sequence from HRSV(A2)__P03421.1__P (opt1)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10744 - RNA, 1101 nt, synthetic construct
  misc_feature 1..1101: note = mRNA product Design c-3 comprising derived and/or modified sequence from HRSV(A2)__P03421.1__P (opt2)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10745 - RNA, 1101 nt, synthetic construct
  misc_feature 1..1101: note = mRNA product Design c-3 comprising derived and/or modified sequence from HRSV(A2)__P03421.1__P (opt3)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10746 - RNA, 1101 nt, synthetic construct
  misc_feature 1..1101: note = mRNA product Design c-3 comprising derived and/or modified sequence from HRSV(A2)__P03421.1__P (opt4)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10747 - RNA, 1101 nt, synthetic construct
  misc_feature 1..1101: note = mRNA product Design c-3 comprising derived and/or modified sequence from HRSV(A2)__P03421.1__P (opt5)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10748 - RNA, 1101 nt, synthetic construct
  misc_feature 1..1101: note = mRNA product Design c-3 comprising derived and/or modified sequence from HRSV(A2)__P03421.1__P (opt6)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10749 - RNA, 1101 nt, synthetic construct
  misc_feature 1..1101: note = mRNA product Design c-3 comprising derived and/or modified sequence from HRSV(A2)__P03421.1__P (opt11)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10750 - RNA, 1097 nt, synthetic construct
  misc_feature 1..1097: note = mRNA product Design c-4 comprising derived and/or modified sequence from HRSV(A2)__P03421.1__P (wt)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10751 - RNA, 1097 nt, synthetic construct
  misc_feature 1..1097: note = mRNA product Design c-4 comprising derived and/or modified sequence from HRSV(A2)__P03421.1__P (opt1)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10752 - RNA, 1097 nt, synthetic construct
  misc_feature 1..1097: note = mRNA product Design c-4 comprising derived and/or modified sequence from HRSV(A2)__P03421.1__P (opt2)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10753 - RNA, 1097 nt, synthetic construct
  misc_feature 1..1097: note = mRNA product Design c-4 comprising derived and/or modified sequence from HRSV(A2)__P03421.1__P (opt3)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10754 - RNA, 1097 nt, synthetic construct
  misc_feature 1..1097: note = mRNA product Design c-4 comprising derived and/or modified sequence from HRSV(A2)__P03421.1__P (opt4)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10755 - RNA, 1097 nt, synthetic construct
  misc_feature 1..1097: note = mRNA product Design c-4 comprising derived and/or modified sequence from HRSV(A2)__P03421.1__P (opt5)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10756 - RNA, 1097 nt, synthetic construct
  misc_feature 1..1097: note = mRNA product Design c-4 comprising derived and/or modified sequence from HRSV(A2)__P03421.1__P (opt6)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10757 - RNA, 1097 nt, synthetic construct
  misc_feature 1..1097: note = mRNA product Design c-4 comprising derived and/or modified sequence from HRSV(A2)__P03421.1__P (opt11)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10758 - RNA, 1015 nt, synthetic construct
  misc_feature 1..1015: note = mRNA product Design c-5 comprising derived and/or modified sequence from HRSV(A2)__P03421.1__P (wt)
  source 1..1015: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10759 - RNA, 1015 nt, synthetic construct
  misc_feature 1..1015: note = mRNA product Design c-5 comprising derived and/or modified sequence from HRSV(A2)__P03421.1__P (opt1)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10760 - RNA, 1015 nt, synthetic construct
  misc_feature 1..1015: note = mRNA product Design c-5 comprising derived and/or modified sequence from HRSV(A2)__P03421.1__P (opt2)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10761 - RNA, 1015 nt, synthetic construct
  misc_feature 1..1015: note = mRNA product Design c-5 comprising derived and/or modified sequence from HRSV(A2)__P03421.1__P (opt3)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10762 - RNA, 1015 nt, synthetic construct
  misc_feature 1..1015: note = mRNA product Design c-5 comprising derived and/or modified sequence from HRSV(A2)__P03421.1__P (opt4)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10763 - RNA, 1015 nt, synthetic construct
  misc_feature 1..1015: note = mRNA product Design c-5 comprising derived and/or modified sequence from HRSV(A2)__P03421.1__P (opt5)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10764 - RNA, 1015 nt, synthetic construct
  misc_feature 1..1015: note = mRNA product Design c-5 comprising derived and/or modified sequence from HRSV(A2)__P03421.1__P (opt6)
  source 1..1015: mol_type = other RNA
gggagagcggctcggccattttgtcccagtcagtccggaggctgcggctgcagaagtaccgcctgcggagtaactgcaaagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10765 - RNA, 1015 nt, synthetic construct
  misc_feature 1..1015: note = mRNA product Design c-5 comprising derived and/or modified sequence from HRSV(A2)__P03421.1__P (opt11)
  source 1..1015: mol_type = other RNA
gggagagcggctcggccattttgtcccagtcagtccggaggctgcggctgcagaagtaccgcctgcggagtaactgcaaagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10766 - RNA, 1024 nt, synthetic construct
  misc_feature 1..1024: note = mRNA product Design d-1 comprising derived and/or modified sequence from HRSV(A2)__P03421.1__P (wt)
  source 1..1024: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10767 - RNA, 1024 nt, synthetic construct
  misc_feature 1..1024: note = mRNA product Design d-1 comprising derived and/or modified sequence from HRSV(A2)__P03421.1__P (opt1)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10768 - RNA, 1024 nt, synthetic construct
  misc_feature 1..1024: note = mRNA product Design d-1 comprising derived and/or modified sequence from HRSV(A2)__P03421.1__P (opt2)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10769 - RNA, 1024 nt, synthetic construct
  misc_feature 1..1024: note = mRNA product Design d-1 comprising derived and/or modified sequence from HRSV(A2)__P03421.1__P (opt3)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10770 - RNA, 1024 nt, synthetic construct
  misc_feature 1..1024: note = mRNA product Design d-1 comprising derived and/or modified sequence from HRSV(A2)__P03421.1__P (opt4)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10771 - RNA, 1024 nt, synthetic construct
  misc_feature 1..1024: note = mRNA product Design d-1 comprising derived and/or modified sequence from HRSV(A2)__P03421.1__P (opt5)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10772 - RNA, 1024 nt, synthetic construct
  misc_feature 1..1024: note = mRNA product Design d-1 comprising derived and/or modified sequence from HRSV(A2)__P03421.1__P (opt6)
  source 1..1024: mol_type = other RNA
gggagacccgtgacccggaagttgtacggctacgcgactttccctcccacaaaccctcgcgcccttcctttcctacttgggcccggcagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10773 - RNA, 1024 nt, synthetic construct
  misc_feature 1..1024: note = mRNA product Design d-1 comprising derived and/or modified sequence from HRSV(A2)__P03421.1__P (opt11)
  source 1..1024: mol_type = other RNA
gggagacccgtgacccggaagttgtacggctacgcgactttccctcccacaaaccctcgcgcccttcctttcctacttgggcccggcagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10774 - RNA, 1079 nt, synthetic construct
  misc_feature 1..1079: note = mRNA product Design d-2 comprising derived and/or modified sequence from HRSV(A2)__P03421.1__P (wt)
  source 1..1079: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10775 - RNA, 1079 nt, synthetic construct
  misc_feature 1..1079: note = mRNA product Design d-2 comprising derived and/or modified sequence from HRSV(A2)__P03421.1__P (opt1)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10776 - RNA, 1079 nt, synthetic construct
  misc_feature 1..1079: note = mRNA product Design d-2 comprising derived and/or modified sequence from HRSV(A2)__P03421.1__P (opt2)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10777 - RNA, 1079 nt, synthetic construct
  misc_feature 1..1079: note = mRNA product Design d-2 comprising derived and/or modified sequence from HRSV(A2)__P03421.1__P (opt3)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10778 - RNA, 1079 nt, synthetic construct
  misc_feature 1..1079: note = mRNA product Design d-2 comprising derived and/or modified sequence from HRSV(A2)__P03421.1__P (opt4)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10779 - RNA, 1079 nt, synthetic construct
  misc_feature 1..1079: note = mRNA product Design d-2 comprising derived and/or modified sequence from HRSV(A2)__P03421.1__P (opt5)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10780 - RNA, 1079 nt, synthetic construct
  misc_feature 1..1079: note = mRNA product Design d-2 comprising derived and/or modified sequence from HRSV(A2)__P03421.1__P (opt6)
  source 1..1079: mol_type = other RNA
gggagagcggctcggccattttgtcccagtcagtccggaggctgcggctgcagaagtaccgcctgcggagtaactgcaaagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10781 - RNA, 1079 nt, synthetic construct
  misc_feature 1..1079: note = mRNA product Design d-2 comprising derived and/or modified sequence from HRSV(A2)__P03421.1__P (opt11)
  source 1..1079: mol_type = other RNA
gggagagcggctcggccattttgtcccagtcagtccggaggctgcggctgcagaagtaccgcctgcggagtaactgcaaagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10782 - RNA, 1395 nt, synthetic construct
  misc_feature 1..1395: note = mRNA product Design d-3 comprising derived and/or modified sequence from HRSV(A2)__P03421.1__P (wt)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10783 - RNA, 1395 nt, synthetic construct
  misc_feature 1..1395: note = mRNA product Design d-3 comprising derived and/or modified sequence from HRSV(A2)__P03421.1__P (opt1)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10784 - RNA, 1395 nt, synthetic construct
  misc_feature 1..1395: note = mRNA product Design d-3 comprising derived and/or modified sequence from HRSV(A2)__P03421.1__P (opt2)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10785 - RNA, 1395 nt, synthetic construct
  misc_feature 1..1395: note = mRNA product Design d-3 comprising derived and/or modified sequence from HRSV(A2)__P03421.1__P (opt3)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10786 - RNA, 1395 nt, synthetic construct
  misc_feature 1..1395: note = mRNA product Design d-3 comprising derived and/or modified sequence from HRSV(A2)__P03421.1__P (opt4)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10787 - RNA, 1395 nt, synthetic construct
  misc_feature 1..1395: note = mRNA product Design d-3 comprising derived and/or modified sequence from HRSV(A2)__P03421.1__P (opt5)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10788 - RNA, 1395 nt, synthetic construct
  misc_feature 1..1395: note = mRNA product Design d-3 comprising derived and/or modified sequence from HRSV(A2)__P03421.1__P (opt6)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10789 - RNA, 1395 nt, synthetic construct
  misc_feature 1..1395: note = mRNA product Design d-3 comprising derived and/or modified sequence from HRSV(A2)__P03421.1__P (opt11)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10790 - RNA, 1078 nt, synthetic construct
  misc_feature 1..1078: note = mRNA product Design d-4 comprising derived and/or modified sequence from HRSV(A2)__P03421.1__P (wt)
  source 1..1078: mol_type = other RNA
gggagagtcccgcagtcggcgtccagcggctctgcttgttcgtgtgtgtgtcgttgcaggccttattcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10791 - RNA, 1078 nt, synthetic construct
  misc_feature 1..1078: note = mRNA product Design d-4 comprising derived and/or modified sequence from HRSV(A2)__P03421.1__P (opt1)
  source 1..1078: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10792 - RNA, 1078 nt, synthetic construct
  misc_feature 1..1078: note = mRNA product Design d-4 comprising derived and/or modified sequence from HRSV(A2)__P03421.1__P (opt2)
  source 1..1078: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10793 - RNA, 1078 nt, synthetic construct
  misc_feature 1..1078: note = mRNA product Design d-4 comprising derived and/or modified sequence from HRSV(A2)__P03421.1__P (opt3)
  source 1..1078: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10794 - RNA, 1078 nt, synthetic construct
  misc_feature 1..1078: note = mRNA product Design d-4 comprising derived and/or modified sequence from HRSV(A2)__P03421.1__P (opt4)
  source 1..1078: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10795 - RNA, 1078 nt, synthetic construct
  misc_feature 1..1078: note = mRNA product Design d-4 comprising derived and/or modified sequence from HRSV(A2)__P03421.1__P (opt5)
  source 1..1078: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10796 - RNA, 1078 nt, synthetic construct
  misc_feature 1..1078: note = mRNA product Design d-4 comprising derived and/or modified sequence from HRSV(A2)__P03421.1__P (opt6)
  source 1..1078: mol_type = other RNA
gggagagtcccgcagtcggcgtccagcggctctgcttgttcgtgtgtgtgtcgttgcaggccttattcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10797 - RNA, 1078 nt, synthetic construct
  misc_feature 1..1078: note = mRNA product Design d-4 comprising derived and/or modified sequence from HRSV(A2)__P03421.1__P (opt11)
  source 1..1078: mol_type = other RNA
gggagagtcccgcagtcggcgtccagcggctctgcttgttcgtgtgtgtgtcgttgcaggccttattcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10798 - RNA, 1175 nt, synthetic construct
  misc_feature 1..1175: note = mRNA product Design d-5 comprising derived and/or modified sequence from HRSV(A2)__P03421.1__P (wt)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10799 - RNA, 1175 nt, synthetic construct
  misc_feature 1..1175: note = mRNA product Design d-5 comprising derived and/or modified sequence from HRSV(A2)__P03421.1__P (opt1)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10800 - RNA, 1175 nt, synthetic construct
  misc_feature 1..1175: note = mRNA product Design d-5 comprising derived and/or modified sequence from HRSV(A2)__P03421.1__P (opt2)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10801 - RNA, 1175 nt, synthetic construct
  misc_feature 1..1175: note = mRNA product Design d-5 comprising derived and/or modified sequence from HRSV(A2)__P03421.1__P (opt3)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10802 - RNA, 1175 nt, synthetic construct
  misc_feature 1..1175: note = mRNA product Design d-5 comprising derived and/or modified sequence from HRSV(A2)__P03421.1__P (opt4)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10803 - RNA, 1175 nt, synthetic construct
  misc_feature 1..1175: note = mRNA product Design d-5 comprising derived and/or modified sequence from HRSV(A2)__P03421.1__P (opt5)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10804 - RNA, 1175 nt, synthetic construct
  misc_feature 1..1175: note = mRNA product Design d-5 comprising derived and/or modified sequence from HRSV(A2)__P03421.1__P (opt6)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10805 - RNA, 1175 nt, synthetic construct
  misc_feature 1..1175: note = mRNA product Design d-5 comprising derived and/or modified sequence from HRSV(A2)__P03421.1__P (opt11)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10806 - RNA, 1055 nt, synthetic construct
  misc_feature 1..1055: note = mRNA product Design e-1 comprising derived and/or modified sequence from HRSV(A2)__P03421.1__P (wt)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10807 - RNA, 1055 nt, synthetic construct
  misc_feature 1..1055: note = mRNA product Design e-1 comprising derived and/or modified sequence from HRSV(A2)__P03421.1__P (opt1)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10808 - RNA, 1055 nt, synthetic construct
  misc_feature 1..1055: note = mRNA product Design e-1 comprising derived and/or modified sequence from HRSV(A2)__P03421.1__P (opt2)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10809 - RNA, 1055 nt, synthetic construct
  misc_feature 1..1055: note = mRNA product Design e-1 comprising derived and/or modified sequence from HRSV(A2)__P03421.1__P (opt3)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10810 - RNA, 1055 nt, synthetic construct
  misc_feature 1..1055: note = mRNA product Design e-1 comprising derived and/or modified sequence from HRSV(A2)__P03421.1__P (opt4)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10811 - RNA, 1055 nt, synthetic construct
  misc_feature 1..1055: note = mRNA product Design e-1 comprising derived and/or modified sequence from HRSV(A2)__P03421.1__P (opt5)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10812 - RNA, 1055 nt, synthetic construct
  misc_feature 1..1055: note = mRNA product Design e-1 comprising derived and/or modified sequence from HRSV(A2)__P03421.1__P (opt6)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10813 - RNA, 1055 nt, synthetic construct
  misc_feature 1..1055: note = mRNA product Design e-1 comprising derived and/or modified sequence from HRSV(A2)__P03421.1__P (opt11)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10814 - RNA, 1037 nt, synthetic construct
  misc_feature 1..1037: note = mRNA product Design e-2 comprising derived and/or modified sequence from HRSV(A2)__P03421.1__P (wt)
  source 1..1037: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10815 - RNA, 1037 nt, synthetic construct
  misc_feature 1..1037: note = mRNA product Design e-2 comprising derived and/or modified sequence from HRSV(A2)__P03421.1__P (opt1)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10816 - RNA, 1037 nt, synthetic construct
  misc_feature 1..1037: note = mRNA product Design e-2 comprising derived and/or modified sequence from HRSV(A2)__P03421.1__P (opt2)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10817 - RNA, 1037 nt, synthetic construct
  misc_feature 1..1037: note = mRNA product Design e-2 comprising derived and/or modified sequence from HRSV(A2)__P03421.1__P (opt3)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10818 - RNA, 1037 nt, synthetic construct
  misc_feature 1..1037: note = mRNA product Design e-2 comprising derived and/or modified sequence from HRSV(A2)__P03421.1__P (opt4)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10819 - RNA, 1037 nt, synthetic construct
  misc_feature 1..1037: note = mRNA product Design e-2 comprising derived and/or modified sequence from HRSV(A2)__P03421.1__P (opt5)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10820 - RNA, 1037 nt, synthetic construct
  misc_feature 1..1037: note = mRNA product Design e-2 comprising derived and/or modified sequence from HRSV(A2)__P03421.1__P (opt6)
  source 1..1037: mol_type = other RNA
gggagacccgtgacccggaagttgtacggctacgcgactttccctcccacaaaccctcgcgcccttcctttcctacttgggcccggcagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10821 - RNA, 1037 nt, synthetic construct
  misc_feature 1..1037: note = mRNA product Design e-2 comprising derived and/or modified sequence from HRSV(A2)__P03421.1__P (opt11)
  source 1..1037: mol_type = other RNA
gggagacccgtgacccggaagttgtacggctacgcgactttccctcccacaaaccctcgcgcccttcctttcctacttgggcccggcagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10822 - RNA, 1007 nt, synthetic construct
  misc_feature 1..1007: note = mRNA product Design e-3 comprising derived and/or modified sequence from HRSV(A2)__P03421.1__P (wt)
  source 1..1007: mol_type = other RNA
gggagactttcccattctgtagcagaatttggtgttgcctgtggtcttggtcccgcggagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10823 - RNA, 1007 nt, synthetic construct
  misc_feature 1..1007: note = mRNA product Design e-3 comprising derived and/or modified sequence from HRSV(A2)__P03421.1__P (opt1)
  source 1..1007: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10824 - RNA, 1007 nt, synthetic construct
  misc_feature 1..1007: note = mRNA product Design e-3 comprising derived and/or modified sequence from HRSV(A2)__P03421.1__P (opt2)
  source 1..1007: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10825 - RNA, 1007 nt, synthetic construct
  misc_feature 1..1007: note = mRNA product Design e-3 comprising derived and/or modified sequence from HRSV(A2)__P03421.1__P (opt3)
  source 1..1007: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10826 - RNA, 1007 nt, synthetic construct
  misc_feature 1..1007: note = mRNA product Design e-3 comprising derived and/or modified sequence from HRSV(A2)__P03421.1__P (opt4)
  source 1..1007: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10827 - RNA, 1007 nt, synthetic construct
  misc_feature 1..1007: note = mRNA product Design e-3 comprising derived and/or modified sequence from HRSV(A2)__P03421.1__P (opt5)
  source 1..1007: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10828 - RNA, 1007 nt, synthetic construct
  misc_feature 1..1007: note = mRNA product Design e-3 comprising derived and/or modified sequence from HRSV(A2)__P03421.1__P (opt6)
  source 1..1007: mol_type = other RNA
gggagactttcccattctgtagcagaatttggtgttgcctgtggtcttggtcccgcggagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10829 - RNA, 1007 nt, synthetic construct
  misc_feature 1..1007: note = mRNA product Design e-3 comprising derived and/or modified sequence from HRSV(A2)__P03421.1__P (opt11)
  source 1..1007: mol_type = other RNA
gggagactttcccattctgtagcagaatttggtgttgcctgtggtcttggtcccgcggagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10830 - RNA, 1061 nt, synthetic construct
  misc_feature 1..1061: note = mRNA product Design e-4 comprising derived and/or modified sequence from HRSV(A2)__P03421.1__P (wt)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10831 - RNA, 1061 nt, synthetic construct
  misc_feature 1..1061: note = mRNA product Design e-4 comprising derived and/or modified sequence from HRSV(A2)__P03421.1__P (opt1)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10832 - RNA, 1061 nt, synthetic construct
  misc_feature 1..1061: note = mRNA product Design e-4 comprising derived and/or modified sequence from HRSV(A2)__P03421.1__P (opt2)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10833 - RNA, 1061 nt, synthetic construct
  misc_feature 1..1061: note = mRNA product Design e-4 comprising derived and/or modified sequence from HRSV(A2)__P03421.1__P (opt3)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10834 - RNA, 1061 nt, synthetic construct
  misc_feature 1..1061: note = mRNA product Design e-4 comprising derived and/or modified sequence from HRSV(A2)__P03421.1__P (opt4)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10835 - RNA, 1061 nt, synthetic construct
  misc_feature 1..1061: note = mRNA product Design e-4 comprising derived and/or modified sequence from HRSV(A2)__P03421.1__P (opt5)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10836 - RNA, 1061 nt, synthetic construct
  misc_feature 1..1061: note = mRNA product Design e-4 comprising derived and/or modified sequence from HRSV(A2)__P03421.1__P (opt6)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10837 - RNA, 1061 nt, synthetic construct
  misc_feature 1..1061: note = mRNA product Design e-4 comprising derived and/or modified sequence from HRSV(A2)__P03421.1__P (opt11)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10838 - RNA, 1028 nt, synthetic construct
  misc_feature 1..1028: note = mRNA product Design e-5 comprising derived and/or modified sequence from HRSV(A2)__P03421.1__P (wt)
  source 1..1028: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10839 - RNA, 1028 nt, synthetic construct
  misc_feature 1..1028: note = mRNA product Design e-5 comprising derived and/or modified sequence from HRSV(A2)__P03421.1__P (opt1)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10840 - RNA, 1028 nt, synthetic construct
  misc_feature 1..1028: note = mRNA product Design e-5 comprising derived and/or modified sequence from HRSV(A2)__P03421.1__P (opt2)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10841 - RNA, 1028 nt, synthetic construct
  misc_feature 1..1028: note = mRNA product Design e-5 comprising derived and/or modified sequence from HRSV(A2)__P03421.1__P (opt3)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10842 - RNA, 1028 nt, synthetic construct
  misc_feature 1..1028: note = mRNA product Design e-5 comprising derived and/or modified sequence from HRSV(A2)__P03421.1__P (opt4)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10843 - RNA, 1028 nt, synthetic construct
  misc_feature 1..1028: note = mRNA product Design e-5 comprising derived and/or modified sequence from HRSV(A2)__P03421.1__P (opt5)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10844 - RNA, 1028 nt, synthetic construct
  misc_feature 1..1028: note = mRNA product Design e-5 comprising derived and/or modified sequence from HRSV(A2)__P03421.1__P (opt6)
  source 1..1028: mol_type = other RNA
gggagagcggctcggccattttgtcccagtcagtccggaggctgcggctgcagaagtaccgcctgcggagtaactgcaaagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10845 - RNA, 1028 nt, synthetic construct
  misc_feature 1..1028: note = mRNA product Design e-5 comprising derived and/or modified sequence from HRSV(A2)__P03421.1__P (opt11)
  source 1..1028: mol_type = other RNA
gggagagcggctcggccattttgtcccagtcagtccggaggctgcggctgcagaagtaccgcctgcggagtaactgcaaagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10846 - RNA, 1095 nt, synthetic construct
  misc_feature 1..1095: note = mRNA product Design e-6 comprising derived and/or modified sequence from HRSV(A2)__P03421.1__P (wt)
  source 1..1095: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10847 - RNA, 1095 nt, synthetic construct
  misc_feature 1..1095: note = mRNA product Design e-6 comprising derived and/or modified sequence from HRSV(A2)__P03421.1__P (opt1)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10848 - RNA, 1095 nt, synthetic construct
  misc_feature 1..1095: note = mRNA product Design e-6 comprising derived and/or modified sequence from HRSV(A2)__P03421.1__P (opt2)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10849 - RNA, 1095 nt, synthetic construct
  misc_feature 1..1095: note = mRNA product Design e-6 comprising derived and/or modified sequence from HRSV(A2)__P03421.1__P (opt3)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10850 - RNA, 1095 nt, synthetic construct
  misc_feature 1..1095: note = mRNA product Design e-6 comprising derived and/or modified sequence from HRSV(A2)__P03421.1__P (opt4)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10851 - RNA, 1095 nt, synthetic construct
  misc_feature 1..1095: note = mRNA product Design e-6 comprising derived and/or modified sequence from HRSV(A2)__P03421.1__P (opt5)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10852 - RNA, 1095 nt, synthetic construct
  misc_feature 1..1095: note = mRNA product Design e-6 comprising derived and/or modified sequence from HRSV(A2)__P03421.1__P (opt6)
  source 1..1095: mol_type = other RNA
gggagagcggctcggccattttgtcccagtcagtccggaggctgcggctgcagaagtaccgcctgcggagtaactgcaaagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10853 - RNA, 1095 nt, synthetic construct
  misc_feature 1..1095: note = mRNA product Design e-6 comprising derived and/or modified sequence from HRSV(A2)__P03421.1__P (opt11)
  source 1..1095: mol_type = other RNA
gggagagcggctcggccattttgtcccagtcagtccggaggctgcggctgcagaagtaccgcctgcggagtaactgcaaagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10854 - RNA, 1311 nt, synthetic construct
  misc_feature 1..1311: note = mRNA product Design f-1 comprising derived and/or modified sequence from HRSV(A2)__P03421.1__P (wt)
  source 1..1311: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10855 - RNA, 1311 nt, synthetic construct
  misc_feature 1..1311: note = mRNA product Design f-1 comprising derived and/or modified sequence from HRSV(A2)__P03421.1__P (opt1)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10856 - RNA, 1311 nt, synthetic construct
  misc_feature 1..1311: note = mRNA product Design f-1 comprising derived and/or modified sequence from HRSV(A2)__P03421.1__P (opt2)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10857 - RNA, 1311 nt, synthetic construct
  misc_feature 1..1311: note = mRNA product Design f-1 comprising derived and/or modified sequence from HRSV(A2)__P03421.1__P (opt3)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10858 - RNA, 1311 nt, synthetic construct
  misc_feature 1..1311: note = mRNA product Design f-1 comprising derived and/or modified sequence from HRSV(A2)__P03421.1__P (opt4)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10859 - RNA, 1311 nt, synthetic construct
  misc_feature 1..1311: note = mRNA product Design f-1 comprising derived and/or modified sequence from HRSV(A2)__P03421.1__P (opt5)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10860 - RNA, 1311 nt, synthetic construct
  misc_feature 1..1311: note = mRNA product Design f-1 comprising derived and/or modified sequence from HRSV(A2)__P03421.1__P (opt6)
  source 1..1311: mol_type = other RNA
gggagagcggctcggccattttgtcccagtcagtccggaggctgcggctgcagaagtaccgcctgcggagtaactgcaaagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10861 - RNA, 1311 nt, synthetic construct
  misc_feature 1..1311: note = mRNA product Design f-1 comprising derived and/or modified sequence from HRSV(A2)__P03421.1__P (opt11)
  source 1..1311: mol_type = other RNA
gggagagcggctcggccattttgtcccagtcagtccggaggctgcggctgcagaagtaccgcctgcggagtaactgcaaagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10862 - RNA, 1091 nt, synthetic construct
  misc_feature 1..1091: note = mRNA product Design f-2 comprising derived and/or modified sequence from HRSV(A2)__P03421.1__P (wt)
  source 1..1091: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10863 - RNA, 1091 nt, synthetic construct
  misc_feature 1..1091: note = mRNA product Design f-2 comprising derived and/or modified sequence from HRSV(A2)__P03421.1__P (opt1)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10864 - RNA, 1091 nt, synthetic construct
  misc_feature 1..1091: note = mRNA product Design f-2 comprising derived and/or modified sequence from HRSV(A2)__P03421.1__P (opt2)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10865 - RNA, 1091 nt, synthetic construct
  misc_feature 1..1091: note = mRNA product Design f-2 comprising derived and/or modified sequence from HRSV(A2)__P03421.1__P (opt3)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10866 - RNA, 1091 nt, synthetic construct
  misc_feature 1..1091: note = mRNA product Design f-2 comprising derived and/or modified sequence from HRSV(A2)__P03421.1__P (opt4)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10867 - RNA, 1091 nt, synthetic construct
  misc_feature 1..1091: note = mRNA product Design f-2 comprising derived and/or modified sequence from HRSV(A2)__P03421.1__P (opt5)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10868 - RNA, 1091 nt, synthetic construct
  misc_feature 1..1091: note = mRNA product Design f-2 comprising derived and/or modified sequence from HRSV(A2)__P03421.1__P (opt6)
  source 1..1091: mol_type = other RNA
gggagagcggctcggccattttgtcccagtcagtccggaggctgcggctgcagaagtaccgcctgcggagtaactgcaaagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10869 - RNA, 1091 nt, synthetic construct
  misc_feature 1..1091: note = mRNA product Design f-2 comprising derived and/or modified sequence from HRSV(A2)__P03421.1__P (opt11)
  source 1..1091: mol_type = other RNA
gggagagcggctcggccattttgtcccagtcagtccggaggctgcggctgcagaagtaccgcctgcggagtaactgcaaagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10870 - RNA, 1082 nt, synthetic construct
  misc_feature 1..1082: note = mRNA product Design f-3 comprising derived and/or modified sequence from HRSV(A2)__P03421.1__P (wt)
  source 1..1082: mol_type = other RNA
gggagagtcccgcagtcggcgtccagcggctctgcttgttcgtgtgtgtgtcgttgcaggccttattcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10871 - RNA, 1082 nt, synthetic construct
  misc_feature 1..1082: note = mRNA product Design f-3 comprising derived and/or modified sequence from HRSV(A2)__P03421.1__P (opt1)
  source 1..1082: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10872 - RNA, 1082 nt, synthetic construct
  misc_feature 1..1082: note = mRNA product Design f-3 comprising derived and/or modified sequence from HRSV(A2)__P03421.1__P (opt2)
  source 1..1082: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10873 - RNA, 1082 nt, synthetic construct
  misc_feature 1..1082: note = mRNA product Design f-3 comprising derived and/or modified sequence from HRSV(A2)__P03421.1__P (opt3)
  source 1..1082: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10874 - RNA, 1082 nt, synthetic construct
  misc_feature 1..1082: note = mRNA product Design f-3 comprising derived and/or modified sequence from HRSV(A2)__P03421.1__P (opt4)
  source 1..1082: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10875 - RNA, 1082 nt, synthetic construct
  misc_feature 1..1082: note = mRNA product Design f-3 comprising derived and/or modified sequence from HRSV(A2)__P03421.1__P (opt5)
  source 1..1082: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10876 - RNA, 1082 nt, synthetic construct
  misc_feature 1..1082: note = mRNA product Design f-3 comprising derived and/or modified sequence from HRSV(A2)__P03421.1__P (opt6)
  source 1..1082: mol_type = other RNA
gggagagtcccgcagtcggcgtccagcggctctgcttgttcgtgtgtgtgtcgttgcaggccttattcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10877 - RNA, 1082 nt, synthetic construct
  misc_feature 1..1082: note = mRNA product Design f-3 comprising derived and/or modified sequence from HRSV(A2)__P03421.1__P (opt11)
  source 1..1082: mol_type = other RNA
gggagagtcccgcagtcggcgtccagcggctctgcttgttcgtgtgtgtgtcgttgcaggccttattcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10878 - RNA, 1298 nt, synthetic construct
  misc_feature 1..1298: note = mRNA product Design f-4 comprising derived and/or modified sequence from HRSV(A2)__P03421.1__P (wt)
  source 1..1298: mol_type = other RNA
gggagagtcccgcagtcggcgtccagcggctctgcttgttcgtgtgtgtgtcgttgcaggccttattcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10879 - RNA, 1298 nt, synthetic construct
  misc_feature 1..1298: note = mRNA product Design f-4 comprising derived and/or modified sequence from HRSV(A2)__P03421.1__P (opt1)
  source 1..1298: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10880 - RNA, 1298 nt, synthetic construct
  misc_feature 1..1298: note = mRNA product Design f-4 comprising derived and/or modified sequence from HRSV(A2)__P03421.1__P (opt2)
  source 1..1298: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10881 - RNA, 1298 nt, synthetic construct
  misc_feature 1..1298: note = mRNA product Design f-4 comprising derived and/or modified sequence from HRSV(A2)__P03421.1__P (opt3)
  source 1..1298: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10882 - RNA, 1298 nt, synthetic construct
  misc_feature 1..1298: note = mRNA product Design f-4 comprising derived and/or modified sequence from HRSV(A2)__P03421.1__P (opt4)
  source 1..1298: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10883 - RNA, 1298 nt, synthetic construct
  misc_feature 1..1298: note = mRNA product Design f-4 comprising derived and/or modified sequence from HRSV(A2)__P03421.1__P (opt5)
  source 1..1298: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10884 - RNA, 1298 nt, synthetic construct
  misc_feature 1..1298: note = mRNA product Design f-4 comprising derived and/or modified sequence from HRSV(A2)__P03421.1__P (opt6)
  source 1..1298: mol_type = other RNA
gggagagtcccgcagtcggcgtccagcggctctgcttgttcgtgtgtgtgtcgttgcaggccttattcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10885 - RNA, 1298 nt, synthetic construct
  misc_feature 1..1298: note = mRNA product Design f-4 comprising derived and/or modified sequence from HRSV(A2)__P03421.1__P (opt11)
  source 1..1298: mol_type = other RNA
gggagagtcccgcagtcggcgtccagcggctctgcttgttcgtgtgtgtgtcgttgcaggccttattcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10886 - RNA, 1074 nt, synthetic construct
  misc_feature 1..1074: note = mRNA product Design f-5 comprising derived and/or modified sequence from HRSV(A2)__P03421.1__P (wt)
  source 1..1074: mol_type = other RNA
gggagactttcccattctgtagcagaatttggtgttgcctgtggtcttggtcccgcggagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10887 - RNA, 1074 nt, synthetic construct
  misc_feature 1..1074: note = mRNA product Design f-5 comprising derived and/or modified sequence from HRSV(A2)__P03421.1__P (opt1)
  source 1..1074: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10888 - RNA, 1074 nt, synthetic construct
  misc_feature 1..1074: note = mRNA product Design f-5 comprising derived and/or modified sequence from HRSV(A2)__P03421.1__P (opt2)
  source 1..1074: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10889 - RNA, 1074 nt, synthetic construct
  misc_feature 1..1074: note = mRNA product Design f-5 comprising derived and/or modified sequence from HRSV(A2)__P03421.1__P (opt3)
  source 1..1074: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10890 - RNA, 1074 nt, synthetic construct
  misc_feature 1..1074: note = mRNA product Design f-5 comprising derived and/or modified sequence from HRSV(A2)__P03421.1__P (opt4)
  source 1..1074: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10891 - RNA, 1074 nt, synthetic construct
  misc_feature 1..1074: note = mRNA product Design f-5 comprising derived and/or modified sequence from HRSV(A2)__P03421.1__P (opt5)
  source 1..1074: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10892 - RNA, 1074 nt, synthetic construct
  misc_feature 1..1074: note = mRNA product Design f-5 comprising derived and/or modified sequence from HRSV(A2)__P03421.1__P (opt6)
  source 1..1074: mol_type = other RNA
gggagactttcccattctgtagcagaatttggtgttgcctgtggtcttggtcccgcggagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10893 - RNA, 1074 nt, synthetic construct
  misc_feature 1..1074: note = mRNA product Design f-5 comprising derived and/or modified sequence from HRSV(A2)__P03421.1__P (opt11)
  source 1..1074: mol_type = other RNA
gggagactttcccattctgtagcagaatttggtgttgcctgtggtcttggtcccgcggagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10894 - RNA, 1070 nt, synthetic construct
  misc_feature 1..1070: note = mRNA product Design g-1 comprising derived and/or modified sequence from HRSV(A2)__P03421.1__P (wt)
  source 1..1070: mol_type = other RNA
gggagactttcccattctgtagcagaatttggtgttgcctgtggtcttggtcccgcggagaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10895 - RNA, 1070 nt, synthetic construct
  misc_feature 1..1070: note = mRNA product Design g-1 comprising derived and/or modified sequence from HRSV(A2)__P03421.1__P (opt1)
  source 1..1070: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10896 - RNA, 1070 nt, synthetic construct
  misc_feature 1..1070: note = mRNA product Design g-1 comprising derived and/or modified sequence from HRSV(A2)__P03421.1__P (opt2)
  source 1..1070: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10897 - RNA, 1070 nt, synthetic construct
  misc_feature 1..1070: note = mRNA product Design g-1 comprising derived and/or modified sequence from HRSV(A2)__P03421.1__P (opt3)
  source 1..1070: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10898 - RNA, 1070 nt, synthetic construct
  misc_feature 1..1070: note = mRNA product Design g-1 comprising derived and/or modified sequence from HRSV(A2)__P03421.1__P (opt4)
  source 1..1070: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10899 - RNA, 1070 nt, synthetic construct
  misc_feature 1..1070: note = mRNA product Design g-1 comprising derived and/or modified sequence from HRSV(A2)__P03421.1__P (opt5)
  source 1..1070: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10900 - RNA, 1070 nt, synthetic construct
  misc_feature 1..1070: note = mRNA product Design g-1 comprising derived and/or modified sequence from HRSV(A2)__P03421.1__P (opt6)
  source 1..1070: mol_type = other RNA
gggagactttcccattctgtagcagaatttggtgttgcctgtggtcttggtcccgcggagaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10901 - RNA, 1070 nt, synthetic construct
  misc_feature 1..1070: note = mRNA product Design g-1 comprising derived and/or modified sequence from HRSV(A2)__P03421.1__P (opt11)
  source 1..1070: mol_type = other RNA
gggagactttcccattctgtagcagaatttggtgttgcctgtggtcttggtcccgcggagaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10902 - RNA, 1085 nt, synthetic construct
  misc_feature 1..1085: note = mRNA product Design g-2 comprising derived and/or modified sequence from HRSV(A2)__P03421.1__P (wt)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10903 - RNA, 1085 nt, synthetic construct
  misc_feature 1..1085: note = mRNA product Design g-2 comprising derived and/or modified sequence from HRSV(A2)__P03421.1__P (opt1)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10904 - RNA, 1085 nt, synthetic construct
  misc_feature 1..1085: note = mRNA product Design g-2 comprising derived and/or modified sequence from HRSV(A2)__P03421.1__P (opt2)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10905 - RNA, 1085 nt, synthetic construct
  misc_feature 1..1085: note = mRNA product Design g-2 comprising derived and/or modified sequence from HRSV(A2)__P03421.1__P (opt3)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10906 - RNA, 1085 nt, synthetic construct
  misc_feature 1..1085: note = mRNA product Design g-2 comprising derived and/or modified sequence from HRSV(A2)__P03421.1__P (opt4)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10907 - RNA, 1085 nt, synthetic construct
  misc_feature 1..1085: note = mRNA product Design g-2 comprising derived and/or modified sequence from HRSV(A2)__P03421.1__P (opt5)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10908 - RNA, 1085 nt, synthetic construct
  misc_feature 1..1085: note = mRNA product Design g-2 comprising derived and/or modified sequence from HRSV(A2)__P03421.1__P (opt6)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10909 - RNA, 1085 nt, synthetic construct
  misc_feature 1..1085: note = mRNA product Design g-2 comprising derived and/or modified sequence from HRSV(A2)__P03421.1__P (opt11)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10910 - RNA, 1317 nt, synthetic construct
  misc_feature 1..1317: note = mRNA product Design g-3 comprising derived and/or modified sequence from HRSV(A2)__P03421.1__P (wt)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10911 - RNA, 1317 nt, synthetic construct
  misc_feature 1..1317: note = mRNA product Design g-3 comprising derived and/or modified sequence from HRSV(A2)__P03421.1__P (opt1)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10912 - RNA, 1317 nt, synthetic construct
  misc_feature 1..1317: note = mRNA product Design g-3 comprising derived and/or modified sequence from HRSV(A2)__P03421.1__P (opt2)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10913 - RNA, 1317 nt, synthetic construct
  misc_feature 1..1317: note = mRNA product Design g-3 comprising derived and/or modified sequence from HRSV(A2)__P03421.1__P (opt3)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10914 - RNA, 1317 nt, synthetic construct
  misc_feature 1..1317: note = mRNA product Design g-3 comprising derived and/or modified sequence from HRSV(A2)__P03421.1__P (opt4)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10915 - RNA, 1317 nt, synthetic construct
  misc_feature 1..1317: note = mRNA product Design g-3 comprising derived and/or modified sequence from HRSV(A2)__P03421.1__P (opt5)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10916 - RNA, 1317 nt, synthetic construct
  misc_feature 1..1317: note = mRNA product Design g-3 comprising derived and/or modified sequence from HRSV(A2)__P03421.1__P (opt6)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10917 - RNA, 1317 nt, synthetic construct
  misc_feature 1..1317: note = mRNA product Design g-3 comprising derived and/or modified sequence from HRSV(A2)__P03421.1__P (opt11)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10918 - RNA, 1112 nt, synthetic construct
  misc_feature 1..1112: note = mRNA product Design g-4 comprising derived and/or modified sequence from HRSV(A2)__P03421.1__P (wt)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10919 - RNA, 1112 nt, synthetic construct
  misc_feature 1..1112: note = mRNA product Design g-4 comprising derived and/or modified sequence from HRSV(A2)__P03421.1__P (opt1)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10920 - RNA, 1112 nt, synthetic construct
  misc_feature 1..1112: note = mRNA product Design g-4 comprising derived and/or modified sequence from HRSV(A2)__P03421.1__P (opt2)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10921 - RNA, 1112 nt, synthetic construct
  misc_feature 1..1112: note = mRNA product Design g-4 comprising derived and/or modified sequence from HRSV(A2)__P03421.1__P (opt3)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10922 - RNA, 1112 nt, synthetic construct
  misc_feature 1..1112: note = mRNA product Design g-4 comprising derived and/or modified sequence from HRSV(A2)__P03421.1__P (opt4)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10923 - RNA, 1112 nt, synthetic construct
  misc_feature 1..1112: note = mRNA product Design g-4 comprising derived and/or modified sequence from HRSV(A2)__P03421.1__P (opt5)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10924 - RNA, 1112 nt, synthetic construct
  misc_feature 1..1112: note = mRNA product Design g-4 comprising derived and/or modified sequence from HRSV(A2)__P03421.1__P (opt6)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10925 - RNA, 1112 nt, synthetic construct
  misc_feature 1..1112: note = mRNA product Design g-4 comprising derived and/or modified sequence from HRSV(A2)__P03421.1__P (opt11)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10926 - RNA, 1088 nt, synthetic construct
  misc_feature 1..1088: note = mRNA product Design g-5 comprising derived and/or modified sequence from HRSV(A2)__P03421.1__P (wt)
  source 1..1088: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10927 - RNA, 1088 nt, synthetic construct
  misc_feature 1..1088: note = mRNA product Design g-5 comprising derived and/or modified sequence from HRSV(A2)__P03421.1__P (opt1)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10928 - RNA, 1088 nt, synthetic construct
  misc_feature 1..1088: note = mRNA product Design g-5 comprising derived and/or modified sequence from HRSV(A2)__P03421.1__P (opt2)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10929 - RNA, 1088 nt, synthetic construct
  misc_feature 1..1088: note = mRNA product Design g-5 comprising derived and/or modified sequence from HRSV(A2)__P03421.1__P (opt3)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10930 - RNA, 1088 nt, synthetic construct
  misc_feature 1..1088: note = mRNA product Design g-5 comprising derived and/or modified sequence from HRSV(A2)__P03421.1__P (opt4)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10931 - RNA, 1088 nt, synthetic construct
  misc_feature 1..1088: note = mRNA product Design g-5 comprising derived and/or modified sequence from HRSV(A2)__P03421.1__P (opt5)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10932 - RNA, 1088 nt, synthetic construct
  misc_feature 1..1088: note = mRNA product Design g-5 comprising derived and/or modified sequence from HRSV(A2)__P03421.1__P (opt6)
  source 1..1088: mol_type = other RNA
gggagacccgtgacccggaagttgtacggctacgcgactttccctcccacaaaccctcgcgcccttcctttcctacttgggcccggcagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10933 - RNA, 1088 nt, synthetic construct
  misc_feature 1..1088: note = mRNA product Design g-5 comprising derived and/or modified sequence from HRSV(A2)__P03421.1__P (opt11)
  source 1..1088: mol_type = other RNA
gggagacccgtgacccggaagttgtacggctacgcgactttccctcccacaaaccctcgcgcccttcctttcctacttgggcccggcagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10934 - RNA, 1104 nt, synthetic construct
  misc_feature 1..1104: note = mRNA product Design h-1 comprising derived and/or modified sequence from HRSV(A2)__P03421.1__P (wt)
  source 1..1104: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10935 - RNA, 1104 nt, synthetic construct
  misc_feature 1..1104: note = mRNA product Design h-1 comprising derived and/or modified sequence from HRSV(A2)__P03421.1__P (opt1)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10936 - RNA, 1104 nt, synthetic construct
  misc_feature 1..1104: note = mRNA product Design h-1 comprising derived and/or modified sequence from HRSV(A2)__P03421.1__P (opt2)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10937 - RNA, 1104 nt, synthetic construct
  misc_feature 1..1104: note = mRNA product Design h-1 comprising derived and/or modified sequence from HRSV(A2)__P03421.1__P (opt3)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10938 - RNA, 1104 nt, synthetic construct
  misc_feature 1..1104: note = mRNA product Design h-1 comprising derived and/or modified sequence from HRSV(A2)__P03421.1__P (opt4)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10939 - RNA, 1104 nt, synthetic construct
  misc_feature 1..1104: note = mRNA product Design h-1 comprising derived and/or modified sequence from HRSV(A2)__P03421.1__P (opt5)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10940 - RNA, 1104 nt, synthetic construct
  misc_feature 1..1104: note = mRNA product Design h-1 comprising derived and/or modified sequence from HRSV(A2)__P03421.1__P (opt6)
  source 1..1104: mol_type = other RNA
gggagacccgtgacccggaagttgtacggctacgcgactttccctcccacaaaccctcgcgcccttcctttcctacttgggcccggcagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10941 - RNA, 1104 nt, synthetic construct
  misc_feature 1..1104: note = mRNA product Design h-1 comprising derived and/or modified sequence from HRSV(A2)__P03421.1__P (opt11)
  source 1..1104: mol_type = other RNA
gggagacccgtgacccggaagttgtacggctacgcgactttccctcccacaaaccctcgcgcccttcctttcctacttgggcccggcagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10942 - RNA, 1320 nt, synthetic construct
  misc_feature 1..1320: note = mRNA product Design h-2 comprising derived and/or modified sequence from HRSV(A2)__P03421.1__P (wt)
  source 1..1320: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10943 - RNA, 1320 nt, synthetic construct
  misc_feature 1..1320: note = mRNA product Design h-2 comprising derived and/or modified sequence from HRSV(A2)__P03421.1__P (opt1)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10944 - RNA, 1320 nt, synthetic construct
  misc_feature 1..1320: note = mRNA product Design h-2 comprising derived and/or modified sequence from HRSV(A2)__P03421.1__P (opt2)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10945 - RNA, 1320 nt, synthetic construct
  misc_feature 1..1320: note = mRNA product Design h-2 comprising derived and/or modified sequence from HRSV(A2)__P03421.1__P (opt3)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10946 - RNA, 1320 nt, synthetic construct
  misc_feature 1..1320: note = mRNA product Design h-2 comprising derived and/or modified sequence from HRSV(A2)__P03421.1__P (opt4)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10947 - RNA, 1320 nt, synthetic construct
  misc_feature 1..1320: note = mRNA product Design h-2 comprising derived and/or modified sequence from HRSV(A2)__P03421.1__P (opt5)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10948 - RNA, 1320 nt, synthetic construct
  misc_feature 1..1320: note = mRNA product Design h-2 comprising derived and/or modified sequence from HRSV(A2)__P03421.1__P (opt6)
  source 1..1320: mol_type = other RNA
gggagacccgtgacccggaagttgtacggctacgcgactttccctcccacaaaccctcgcgcccttcctttcctacttgggcccggcagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10949 - RNA, 1320 nt, synthetic construct
  misc_feature 1..1320: note = mRNA product Design h-2 comprising derived and/or modified sequence from HRSV(A2)__P03421.1__P (opt11)
  source 1..1320: mol_type = other RNA
gggagacccgtgacccggaagttgtacggctacgcgactttccctcccacaaaccctcgcgcccttcctttcctacttgggcccggcagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10950 - RNA, 1100 nt, synthetic construct
  misc_feature 1..1100: note = mRNA product Design h-3 comprising derived and/or modified sequence from HRSV(A2)__P03421.1__P (wt)
  source 1..1100: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10951 - RNA, 1100 nt, synthetic construct
  misc_feature 1..1100: note = mRNA product Design h-3 comprising derived and/or modified sequence from HRSV(A2)__P03421.1__P (opt1)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10952 - RNA, 1100 nt, synthetic construct
  misc_feature 1..1100: note = mRNA product Design h-3 comprising derived and/or modified sequence from HRSV(A2)__P03421.1__P (opt2)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10953 - RNA, 1100 nt, synthetic construct
  misc_feature 1..1100: note = mRNA product Design h-3 comprising derived and/or modified sequence from HRSV(A2)__P03421.1__P (opt3)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10954 - RNA, 1100 nt, synthetic construct
  misc_feature 1..1100: note = mRNA product Design h-3 comprising derived and/or modified sequence from HRSV(A2)__P03421.1__P (opt4)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10955 - RNA, 1100 nt, synthetic construct
  misc_feature 1..1100: note = mRNA product Design h-3 comprising derived and/or modified sequence from HRSV(A2)__P03421.1__P (opt5)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10956 - RNA, 1100 nt, synthetic construct
  misc_feature 1..1100: note = mRNA product Design h-3 comprising derived and/or modified sequence from HRSV(A2)__P03421.1__P (opt6)
  source 1..1100: mol_type = other RNA
gggagacccgtgacccggaagttgtacggctacgcgactttccctcccacaaaccctcgcgcccttcctttcctacttgggcccggcagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10957 - RNA, 1100 nt, synthetic construct
  misc_feature 1..1100: note = mRNA product Design h-3 comprising derived and/or modified sequence from HRSV(A2)__P03421.1__P (opt11)
  source 1..1100: mol_type = other RNA
gggagacccgtgacccggaagttgtacggctacgcgactttccctcccacaaaccctcgcgcccttcctttcctacttgggcccggcagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10958 - RNA, 1163 nt, synthetic construct
  misc_feature 1..1163: note = mRNA product Design h-4 comprising derived and/or modified sequence from HRSV(A2)__P03421.1__P (wt)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10959 - RNA, 1163 nt, synthetic construct
  misc_feature 1..1163: note = mRNA product Design h-4 comprising derived and/or modified sequence from HRSV(A2)__P03421.1__P (opt1)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10960 - RNA, 1163 nt, synthetic construct
  misc_feature 1..1163: note = mRNA product Design h-4 comprising derived and/or modified sequence from HRSV(A2)__P03421.1__P (opt2)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10961 - RNA, 1163 nt, synthetic construct
  misc_feature 1..1163: note = mRNA product Design h-4 comprising derived and/or modified sequence from HRSV(A2)__P03421.1__P (opt3)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10962 - RNA, 1163 nt, synthetic construct
  misc_feature 1..1163: note = mRNA product Design h-4 comprising derived and/or modified sequence from HRSV(A2)__P03421.1__P (opt4)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10963 - RNA, 1163 nt, synthetic construct
  misc_feature 1..1163: note = mRNA product Design h-4 comprising derived and/or modified sequence from HRSV(A2)__P03421.1__P (opt5)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10964 - RNA, 1163 nt, synthetic construct
  misc_feature 1..1163: note = mRNA product Design h-4 comprising derived and/or modified sequence from HRSV(A2)__P03421.1__P (opt6)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10965 - RNA, 1163 nt, synthetic construct
  misc_feature 1..1163: note = mRNA product Design h-4 comprising derived and/or modified sequence from HRSV(A2)__P03421.1__P (opt11)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10966 - RNA, 1179 nt, synthetic construct
  misc_feature 1..1179: note = mRNA product Design h-5 comprising derived and/or modified sequence from HRSV(A2)__P03421.1__P (wt)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10967 - RNA, 1179 nt, synthetic construct
  misc_feature 1..1179: note = mRNA product Design h-5 comprising derived and/or modified sequence from HRSV(A2)__P03421.1__P (opt1)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10968 - RNA, 1179 nt, synthetic construct
  misc_feature 1..1179: note = mRNA product Design h-5 comprising derived and/or modified sequence from HRSV(A2)__P03421.1__P (opt2)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10969 - RNA, 1179 nt, synthetic construct
  misc_feature 1..1179: note = mRNA product Design h-5 comprising derived and/or modified sequence from HRSV(A2)__P03421.1__P (opt3)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10970 - RNA, 1179 nt, synthetic construct
  misc_feature 1..1179: note = mRNA product Design h-5 comprising derived and/or modified sequence from HRSV(A2)__P03421.1__P (opt4)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10971 - RNA, 1179 nt, synthetic construct
  misc_feature 1..1179: note = mRNA product Design h-5 comprising derived and/or modified sequence from HRSV(A2)__P03421.1__P (opt5)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10972 - RNA, 1179 nt, synthetic construct
  misc_feature 1..1179: note = mRNA product Design h-5 comprising derived and/or modified sequence from HRSV(A2)__P03421.1__P (opt6)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10973 - RNA, 1179 nt, synthetic construct
  misc_feature 1..1179: note = mRNA product Design h-5 comprising derived and/or modified sequence from HRSV(A2)__P03421.1__P (opt11)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10974 - RNA, 1112 nt, synthetic construct
  misc_feature 1..1112: note = mRNA product Design i-1 comprising derived and/or modified sequence from HRSV(A2)__P03421.1__P (wt)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10975 - RNA, 1112 nt, synthetic construct
  misc_feature 1..1112: note = mRNA product Design i-1 comprising derived and/or modified sequence from HRSV(A2)__P03421.1__P (opt1)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10976 - RNA, 1112 nt, synthetic construct
  misc_feature 1..1112: note = mRNA product Design i-1 comprising derived and/or modified sequence from HRSV(A2)__P03421.1__P (opt2)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10977 - RNA, 1112 nt, synthetic construct
  misc_feature 1..1112: note = mRNA product Design i-1 comprising derived and/or modified sequence from HRSV(A2)__P03421.1__P (opt3)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10978 - RNA, 1112 nt, synthetic construct
  misc_feature 1..1112: note = mRNA product Design i-1 comprising derived and/or modified sequence from HRSV(A2)__P03421.1__P (opt4)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10979 - RNA, 1112 nt, synthetic construct
  misc_feature 1..1112: note = mRNA product Design i-1 comprising derived and/or modified sequence from HRSV(A2)__P03421.1__P (opt5)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10980 - RNA, 1112 nt, synthetic construct
  misc_feature 1..1112: note = mRNA product Design i-1 comprising derived and/or modified sequence from HRSV(A2)__P03421.1__P (opt6)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10981 - RNA, 1112 nt, synthetic construct
  misc_feature 1..1112: note = mRNA product Design i-1 comprising derived and/or modified sequence from HRSV(A2)__P03421.1__P (opt11)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10982 - RNA, 1112 nt, synthetic construct
  misc_feature 1..1112: note = mRNA product Design i-2 comprising derived and/or modified sequence from HRSV(A2)__P03421.1__P (wt)
  source 1..1112: mol_type = other RNA
gggagaggcgctgcctacggaggtggcagccatctccttctcggcatcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10983 - RNA, 1112 nt, synthetic construct
  misc_feature 1..1112: note = mRNA product Design i-2 comprising derived and/or modified sequence from HRSV(A2)__P03421.1__P (opt1)
  source 1..1112: mol_type = other RNA
gggagaggcgctgcctacggaggtggcagccatctccttctcggcatcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10984 - RNA, 1112 nt, synthetic construct
  misc_feature 1..1112: note = mRNA product Design i-2 comprising derived and/or modified sequence from HRSV(A2)__P03421.1__P (opt2)
  source 1..1112: mol_type = other RNA
gggagaggcgctgcctacggaggtggcagccatctccttctcggcatcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10985 - RNA, 1112 nt, synthetic construct
  misc_feature 1..1112: note = mRNA product Design i-2 comprising derived and/or modified sequence from HRSV(A2)__P03421.1__P (opt3)
  source 1..1112: mol_type = other RNA
gggagaggcgctgcctacggaggtggcagccatctccttctcggcatcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10986 - RNA, 1112 nt, synthetic construct
  misc_feature 1..1112: note = mRNA product Design i-2 comprising derived and/or modified sequence from HRSV(A2)__P03421.1__P (opt4)
  source 1..1112: mol_type = other RNA
gggagaggcgctgcctacggaggtggcagccatctccttctcggcatcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10987 - RNA, 1112 nt, synthetic construct
  misc_feature 1..1112: note = mRNA product Design i-2 comprising derived and/or modified sequence from HRSV(A2)__P03421.1__P (opt5)
  source 1..1112: mol_type = other RNA
gggagaggcgctgcctacggaggtggcagccatctccttctcggcatcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10988 - RNA, 1112 nt, synthetic construct
  misc_feature 1..1112: note = mRNA product Design i-2 comprising derived and/or modified sequence from HRSV(A2)__P03421.1__P (opt6)
  source 1..1112: mol_type = other RNA
gggagaggcgctgcctacggaggtggcagccatctccttctcggcatcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10989 - RNA, 1112 nt, synthetic construct
  misc_feature 1..1112: note = mRNA product Design i-2 comprising derived and/or modified sequence from HRSV(A2)__P03421.1__P (opt11)
  source 1..1112: mol_type = other RNA
gggagaggcgctgcctacggaggtggcagccatctccttctcggcatcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10990 - RNA, 1108 nt, synthetic construct
  misc_feature 1..1108: note = mRNA product Design i-2 comprising derived and/or modified sequence from HRSV(A2)__P03421.1__P (wt)
  source 1..1108: mol_type = other RNA
ggggcgctgcctacggaggtggcagccatctccttctcggcatcaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10991 - RNA, 1108 nt, synthetic construct
  misc_feature 1..1108: note = mRNA product Design i-2 comprising derived and/or modified sequence from HRSV(A2)__P03421.1__P (opt1)
  source 1..1108: mol_type = other RNA
ggggcgctgcctacggaggtggcagccatctccttctcggcatcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10992 - RNA, 1108 nt, synthetic construct
  misc_feature 1..1108: note = mRNA product Design i-2 comprising derived and/or modified sequence from HRSV(A2)__P03421.1__P (opt2)
  source 1..1108: mol_type = other RNA
ggggcgctgcctacggaggtggcagccatctccttctcggcatcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10993 - RNA, 1108 nt, synthetic construct
  misc_feature 1..1108: note = mRNA product Design i-2 comprising derived and/or modified sequence from HRSV(A2)__P03421.1__P (opt3)
  source 1..1108: mol_type = other RNA
ggggcgctgcctacggaggtggcagccatctccttctcggcatcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10994 - RNA, 1108 nt, synthetic construct
  misc_feature 1..1108: note = mRNA product Design i-2 comprising derived and/or modified sequence from HRSV(A2)__P03421.1__P (opt4)
  source 1..1108: mol_type = other RNA
ggggcgctgcctacggaggtggcagccatctccttctcggcatcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10995 - RNA, 1108 nt, synthetic construct
  misc_feature 1..1108: note = mRNA product Design i-2 comprising derived and/or modified sequence from HRSV(A2)__P03421.1__P (opt5)
  source 1..1108: mol_type = other RNA
ggggcgctgcctacggaggtggcagccatctccttctcggcatcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10996 - RNA, 1108 nt, synthetic construct
  misc_feature 1..1108: note = mRNA product Design i-2 comprising derived and/or modified sequence from HRSV(A2)__P03421.1__P (opt6)
  source 1..1108: mol_type = other RNA
ggggcgctgcctacggaggtggcagccatctccttctcggcatcaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10997 - RNA, 1108 nt, synthetic construct
  misc_feature 1..1108: note = mRNA product Design i-2 comprising derived and/or modified sequence from HRSV(A2)__P03421.1__P (opt11)
  source 1..1108: mol_type = other RNA
ggggcgctgcctacggaggtggcagccatctccttctcggcatcaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10998 - RNA, 943 nt, synthetic construct
  misc_feature 1..943: note = mRNA product Design i-3 comprising derived and/or modified sequence from HRSV(A2)__P03421.1__P (wt)
  source 1..943: mol_type = other RNA
gggagaaagcttaccatggaaaagtttgctcctgaattccatggagaagatgcaaacaacagggctactaaattcctagaatcaataaagggcaaattcacatcacccaaagatcccaagaaaaaagatagtatcatatctgtcaactcaatagatatagaagtaaccaaagaaagccctataacatcaaattcaactattatcaacccaacaaatgagacagatgatactgcagggaacaagcccaattatcaaagaaaacctctagtaagtttcaaagaagaccctacaccaagtgataatcccttttctaaactatacaaagaaaccatagaaacatttgataacaatgaagaagaatccagctattcatacgaagaaataaatgatcagacaaacgataatataacagcaagattagataggattgatgaaaaattaagtgaaatactaggaatgcttcacacattagtagtggcaagtgcaggacctacatctgctcgggatggtataagagatgccatgattggtttaagagaagaaatgatagaaaaaatcagaactgaagcattaatgaccaatgacagattagaagctatggcaagactcaggaatgaggaaagtgaaaagatggcaaaagacacatcagatgaagtgtctctcaatccaacatcagagaaattgaacaacctattggaagggaatgatagtgacaatgatctatcacttgaagatttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10999 - RNA, 943 nt, synthetic construct
  misc_feature 1..943: note = mRNA product Design i-3 comprising derived and/or modified sequence from HRSV(A2)__P03421.1__P (opt1) R7596
  source 1..943: mol_type = other RNA
gggagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11000 - RNA, 943 nt, synthetic construct
  misc_feature 1..943: note = mRNA product Design i-3 comprising derived and/or modified sequence from HRSV(A2)__P03421.1__P (opt2)
  source 1..943: mol_type = other RNA
gggagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatgatcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11001 - RNA, 943 nt, synthetic construct
  misc_feature 1..943: note = mRNA product Design i-3 comprising derived and/or modified sequence from HRSV(A2)__P03421.1__P (opt3)
  source 1..943: mol_type = other RNA
gggagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatgataggactcagagaagagatgattgagaaaatcaggaccgaagctctgatgacaaacgaccggcttgaggcaatggcccgcctgagaaatgaagagagtgaaaagatggctaaagatactagcgacgaggtgtctttgaaccctacctccgagaagctcaacaatctgctggaaggcaacgattcagacaatgatctcagcttagaggacttttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11002 - RNA, 943 nt, synthetic construct
  misc_feature 1..943: note = mRNA product Design i-3 comprising derived and/or modified sequence from HRSV(A2)__P03421.1__P (opt4)
  source 1..943: mol_type = other RNA
gggagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatgatcggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11003 - RNA, 943 nt, synthetic construct
  misc_feature 1..943: note = mRNA product Design i-3 comprising derived and/or modified sequence from HRSV(A2)__P03421.1__P (opt5)
  source 1..943: mol_type = other RNA
gggagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatgattggcctgagagaagagatgatcgagaaaatccggaccgaagctctcatgacgaacgaccgcctggaggccatggcgagactgcggaatgaagagagcgaaaagatggccaaagatacatctgacgaggtctccctcaaccctaccagcgagaagctgaacaatcttctggaagggaacgattccgacaatgatctctctctggaggacttttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11004 - RNA, 943 nt, synthetic construct
  misc_feature 1..943: note = mRNA product Design i-3 comprising derived and/or modified sequence from HRSV(A2)__P03421.1__P (opt6)
  source 1..943: mol_type = other RNA
gggagaaagcttaccatggaaaaattcgcaccagaatttcacggagaagacgcaaacaacagagcaacaaaattcttagaatcaatcaaaggaaaattcacaagcccaaaagacccaaaaaaaaaagactcaataataagcgtaaactcaatagacatagaagtaacaaaagaaagcccaataacaagcaacagcacaataataaacccaacaaacgaaacagatgacacagctggaaataaaccaaactaccaaagaaaacccctagtcagcttcaaagaagaccccacaccatcagacaacccattcagcaaactatataaagaaacaatagaaacatttgacaacaacgaagaagaatcatcatactcatacgaagaaataaacgaccaaacaaacgacaacataaccgcaagattagacagaatagatgaaaaactatcagaaatactaggaatgctacacacattagtagtagcaagcgcaggaccaacatcagcaagagacggaataagagacgcaatgataggactcagagaagaaatgatagaaaaaataagaacagaagcactaatgacaaacgacagattagaagcaatggcaagactaagaaatgaagaatcggaaaaaatggcaaaagacacatcagacgaagtaagcctaaacccaacatcagaaaaattaaataacctactagaaggaaacgacagcgacaacgacttatcactagaagacttctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11005 - RNA, 943 nt, synthetic construct
  misc_feature 1..943: note = mRNA product Design i-3 comprising derived and/or modified sequence from HRSV(A2)__P03421.1__P (opt11)
  source 1..943: mol_type = other RNA
gggagaaagcttaccatggaaaaattcgcgcccgagttccacggcgaggacgcgaacaaccgcgcgacaaagttcctagaatcaatcaagggcaaattcacgagcccgaaagaccccaagaaaaaggactcaatcataagcgtgaactcgatcgacatcgaggtcacgaaagagagcccgatcacaagcaacagcaccataataaacccgaccaacgaaacagacgacaccgcgggcaacaaaccgaactaccaaagaaaaccgctcgtgagcttcaaagaagacccgaccccaagcgacaacccgttctcaaaactatacaaggaaacgatcgagaccttcgacaacaacgaggaagagagctcgtactcgtacgaggaaataaacgaccaaacaaacgacaacataaccgcacgcctagacaggatcgacgaaaaactctcggaaatactcgggatgctacacacgctcgtggtcgcgagcgcaggcccgacctcggccagggacggcatcagggacgcaatgataggcctgcgagaggaaatgatcgagaaaatacgcaccgaagcactcatgaccaacgacagactcgaagccatggccaggctcaggaacgaagaatccgaaaagatggcgaaagacacctcggacgaggtctcgctcaaccccacgagcgagaaactgaacaacctactggaagggaacgacagcgacaacgacctttccctcgaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11006 - protein, 241 aa, synthetic construct
  REGION 1..241: note = derived and/or modified protein sequence (wt) from HRSV(Memphis-37)__AIY60637.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11007 - protein, 241 aa, synthetic construct
  REGION 1..241: note = derived and/or modified protein sequence (wt) from HRSV__O42062.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVPLNPTSKKLSDLLEDNDSDNDLSLDDF

SEQ ID NO: 11008 - protein, 241 aa, synthetic construct
  REGION 1..241: note = derived and/or modified protein sequence (wt) from HRSV__AAA47419.1__P
MEKFAPEFHGEEANNKATKFLESIKGKFASSKDPKKKDSIISVNSIDIEVTKESPITSGTNIINPISEADSTPEAKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11009 - protein, 241 aa, synthetic construct
  REGION 1..241: note = derived and/or modified protein sequence (wt) from HRSV__AAC57023.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLDDF

SEQ ID NO: 11010 - protein, 241 aa, synthetic construct
  REGION 1..241: note = derived and/or modified protein sequence (wt) from HRSV__AAL50987.1__P
MEKFAPEFHGEDANNRATKFLESIKGKFTSPKDPKKKDSIISVNSIDIEVTKESPITSNSTIINPINETDDTVENKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11011 - protein, 241 aa, synthetic construct
  REGION 1..241: note = derived and/or modified protein sequence (wt) from HRSV__AAL50988.1__P
MEKFAPEFHGEDANNRATKFLESVKGKFTSPKDPKKKDSIISVNSIDIEVTKESPITSNSTIINPTNETDDTVGNKPNYQRKPLVSFKEDPMPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGDDSDNDLSLEDF

SEQ ID NO: 11012 - protein, 241 aa, synthetic construct
  REGION 1..241: note = derived and/or modified protein sequence (wt) from HRSV__AAL50989.1__P
MEKFAPEFHGEDANNRATKFLESIKGKFTSPKDPKKKDSIISVNSIDIEVTKESPITSNSTIMNPTNETDDTVGNKPNYQRKPLVSFKEDPMLSDNPFSKLYKETIETFDNNEEESSYSYEEINDQTNDNITARLDRIDEKLSEILGMLHTLVVASAGPTSARDGIRDAMVGLREEMIEKIRTEALMTNNRLEAMARLRNEESEKMAKDTSDEVSLNPTSEKLNNLLEGNDSDDDLSLEDF

SEQ ID NO: 11013 - protein, 241 aa, synthetic construct
  REGION 1..241: note = derived and/or modified protein sequence (wt) from HRSV__AAL57832.1__P
MEKFAPEFHGEDANNKATKFLESIKGKFASSKDPKKKDSIISVNSIDIEVTKESPITSGTNIINPTSEADSTPETKANYPRKPLDSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11014 - protein, 241 aa, synthetic construct
  REGION 1..241: note = derived and/or modified protein sequence (wt) from HRSV__AAL57833.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11015 - protein, 241 aa, synthetic construct
  REGION 1..241: note = derived and/or modified protein sequence (wt) from HRSV__AAR14262.1__P
MEKFAPEFHGEDANNKATKFLESIKGKFASSKDPKKKDSIISVNSIDIEVTKESPITSGTNINNPTSEADSTPEAKTNYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11016 - protein, 241 aa, synthetic construct
  REGION 1..241: note = derived and/or modified protein sequence (wt) from HRSV__AAX23990.1__P
MEKFAPEFHGEDANNRATKFLESIKGKFTSPKDPKKKDSIISVNSIDIEVTKESPITSNSTIINPTNETDDNAGNKPNYQRKPLVSFKEDPIPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11017 - protein, 241 aa, synthetic construct
  REGION 1..241: note = derived and/or modified protein sequence (wt) from HRSV__ACY68431.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11018 - protein, 241 aa, synthetic construct
  REGION 1..241: note = derived and/or modified protein sequence (wt) from HRSV__AEO45855.1__P
MEKFAPEFHGEDANNRATKFLESIKGKFTSPKDPKKKDSIISVNSIDIEVTKESPITSNSTIINPTNETDDTTGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11019 - protein, 241 aa, synthetic construct
  REGION 1..241: note = derived and/or modified protein sequence (wt) from HRSV__AEQ63330.1__P
MEKFAPEFHGEDANNRATKFLESIKGKFTSPKDPKKKDSIISVNSIDIEVTKESPITSNSTIINPINETDDTVGSKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11020 - protein, 241 aa, synthetic construct
  REGION 1..241: note = derived and/or modified protein sequence (wt) from HRSV__AEQ63396.1__P
MEKFAPEFHGEDANNRATKFLESIKGKFTSPKDPKKKDSIISVNSIDIEVTKESPITSNSTIINPINETDDNVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11021 - protein, 241 aa, synthetic construct
  REGION 1..241: note = derived and/or modified protein sequence (wt) from HRSV__AEQ63429.1__P
MEKFAPEFHGEDANNKATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11022 - protein, 241 aa, synthetic construct
  REGION 1..241: note = derived and/or modified protein sequence (wt) from HRSV__AEQ63483.1__P
MEKFAPEFHGEDANNRATKFLESIKGKFTSPKDPKKKDSIISVNSIDIEVTKESPITSNSTIINPTNETDDTVVNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11023 - protein, 241 aa, synthetic construct
  REGION 1..241: note = derived and/or modified protein sequence (wt) from HRSV__AEQ63604.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTSDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11024 - protein, 241 aa, synthetic construct
  REGION 1..241: note = derived and/or modified protein sequence (wt) from HRSV__AEQ63648.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNHEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11025 - protein, 241 aa, synthetic construct
  REGION 1..241: note = derived and/or modified protein sequence (wt) from HRSV__AEQ63670.1__P
MEKFAPEFHGEDANNKATKFLESIKGKFASSKDPKKKDSIISVNSIDIEVTKESPITSGTNIINLTSEANSTPETKANYPRKPLVSFKEDLAPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11026 - protein, 241 aa, synthetic construct
  REGION 1..241: note = derived and/or modified protein sequence (wt) from HRSV__AFI25247.1__P
MEKFAPEFHGEDANNKATKFLESIKGKFASSKDPKKKDSIISVNSIDIEVTKESPITSGTNIINPASEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11027 - protein, 241 aa, synthetic construct
  REGION 1..241: note = derived and/or modified protein sequence (wt) from HRSV__AFM55328.1__P
MEKFAPEFHGEDANNRATKFLESIKGKFTSPKDPKKKDSIISVNSIDIEVTKESPITSNSTIINPINETDDTIGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11028 - protein, 241 aa, synthetic construct
  REGION 1..241: note = derived and/or modified protein sequence (wt) from HRSV__AFM55449.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTTDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11029 - protein, 241 aa, synthetic construct
  REGION 1..241: note = derived and/or modified protein sequence (wt) from HRSV__AFM55493.1__P
MEKFAPEFHGEDANNRATKFLESIKGKFTSPKDPKKKDSIISVNSIDIDVTKESPITSNSTIINPINETDDIVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11030 - protein, 241 aa, synthetic construct
  REGION 1..241: note = derived and/or modified protein sequence (wt) from HRSV__AFM95398.1__P
MEKFAPEFHGEDANNRATKFLESIKGKFTSPKDPKKKDSIISVNSIDIEVTKESPITSNSNIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11031 - protein, 241 aa, synthetic construct
  REGION 1..241: note = derived and/or modified protein sequence (wt) from HRSV__AGN28535.1__P
MEKFAPEFHGEDANNKATKFLESIKGKFASSKDPKKKDSIISVNSIDIEVTKESPITSGSNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11032 - protein, 241 aa, synthetic construct
  REGION 1..241: note = derived and/or modified protein sequence (wt) from HRSV__AGN28579.1__P
MEKFAPEFHGEDANNKATKFLESIKGKFASSKDPKKKDSIISVNSIDIEVTKESPITSGTNIINPTSEVDSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11033 - protein, 241 aa, synthetic construct
  REGION 1..241: note = derived and/or modified protein sequence (wt) from HRSV__AGN28634.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMTKDTSDEVSLNPTSKKLSDLLEDNDSDNDLSLDDF

SEQ ID NO: 11034 - protein, 241 aa, synthetic construct
  REGION 1..241: note = derived and/or modified protein sequence (wt) from HRSV__AGN28645.1__P
MEKFAPEFHGEDANNKATKFLESIKGKFASSKDPKKKDSIISVNSIDIEVTKESPITSGTNIINPTNEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11035 - protein, 241 aa, synthetic construct
  REGION 1..241: note = derived and/or modified protein sequence (wt) from HRSV__AGN28722.1__P
MEKFAPEFHGEEANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11036 - protein, 241 aa, synthetic construct
  REGION 1..241: note = derived and/or modified protein sequence (wt) from HRSV__AGN28777.1__P
MEKFAPEFHGEDANNKATKFLESIKGKFSSSKDPKKKDSIISVNSIDIEVTKESPITSGTNIINPTSEADSTPETKVNYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11037 - protein, 241 aa, synthetic construct
  REGION 1..241: note = derived and/or modified protein sequence (wt) from HRSV__AGN28788.1__P
MEKFAPEFHGEDANNKATKFLESIKGKFASSKDPKKKDSIISVNSIDIEVTKESPITSGTNIINPTSEADSTPETKANYQRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11038 - protein, 241 aa, synthetic construct
  REGION 1..241: note = derived and/or modified protein sequence (wt) from HRSV__AHA83617.1__P
MEKFAPEFHGEDANNRATKFLESIKGKFTSPKDPKKKDSIISVNSIDIEATKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11039 - protein, 241 aa, synthetic construct
  REGION 1..241: note = derived and/or modified protein sequence (wt) from HRSV__AHA83701.1__P
MEKFAPEFHGEDANNKATKFLESIKGKFASSKDPKKKDSIISVNSIDIEVTKESPITSGTNIINPTSEADSTPESKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11040 - protein, 241 aa, synthetic construct
  REGION 1..241: note = derived and/or modified protein sequence (wt) from HRSV__AHA83734.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLDGNDSDNDLSLEDF

SEQ ID NO: 11041 - protein, 241 aa, synthetic construct
  REGION 1..241: note = derived and/or modified protein sequence (wt) from HRSV__AHA83800.1__P
MEKFAPEFHGEDANNKATKFLESIKGKFASSKDSKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11042 - protein, 241 aa, synthetic construct
  REGION 1..241: note = derived and/or modified protein sequence (wt) from HRSV__AHA83887.1__P
MEKFAPEFHGEDANNKATKFLESIKGKFASSKDPKKKDSIISVNSIDIEVTKESPITSGTNIINPTSEADSTPETKANYPRKPLVSFKEDLAPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11043 - protein, 241 aa, synthetic construct
  REGION 1..241: note = derived and/or modified protein sequence (wt) from HRSV__AHA84008.1__P
MEKFAPEFHGEDANNKATKFLESIKGKFASSKDPKKKDSIISVNSIDIEVTKESPITSGTTVINPTSEADSTPETKTNYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11044 - protein, 241 aa, synthetic construct
  REGION 1..241: note = derived and/or modified protein sequence (wt) from HRSV__AHE57680.1__P
MEKFAPEFHGEDANNRATKFLESIKGKFTSPKDPKKKDSIISVNSIDIEVTKESPITSNSTIINPTNETDDTSGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11045 - protein, 241 aa, synthetic construct
  REGION 1..241: note = derived and/or modified protein sequence (wt) from HRSV__AHE57890.1__P
MEKFAPEFHGEDANNRATKFLESIKGKFTSPKDPKKKDSIISVNSIDIEVTKESPITSNSTIINPTNETDDTSGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMVKDTSDEVSLNPTSEKLNNLLEGNDSDNDLSLEDF

SEQ ID NO: 11046 - protein, 241 aa, synthetic construct
  REGION 1..241: note = derived and/or modified protein sequence (wt) from HRSV__AHV80765.1__P
MEKFAPEFHGEDANNRATKFLESIKGKFTSPKDPKKKDSIISVNSIDIEVTKESPITSNSTIINPINETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11047 - protein, 241 aa, synthetic construct
  REGION 1..241: note = derived and/or modified protein sequence (wt) from HRSV__AHV80799.1__P
MEKFAPEFHGEDANNKATKFLESIKGKFASSKDPKKKDSIISVNSIDIEVNKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11048 - protein, 241 aa, synthetic construct
  REGION 1..241: note = derived and/or modified protein sequence (wt) from HRSV__AHV81041.1__P
MEKFAPEFHGEDANNRATKFLESIKGKFTSPKDPKKKDSIISVNSIDIEVTKESPITSNSTIINPINEIDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11049 - protein, 241 aa, synthetic construct
  REGION 1..241: note = derived and/or modified protein sequence (wt) from HRSV__AHV81085.1__P
MEKFAPEFHGEDANNKATKFLESIKGKFASSKDPKKKDSIISVNSIDIEVTKESPITSGTNIINPTSEADSTPDTKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11050 - protein, 241 aa, synthetic construct
  REGION 1..241: note = derived and/or modified protein sequence (wt) from HRSV__AHV81129.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITVRLDRIDEKLSEILGMLHTLVVASAGPTSARDGIRDAMVGLREEMIEKIRTEALMTNDRLEAMARLRNEESEKMVKDTSDEVSLNPTSEKLNNLLEGNDSDNDLSLEDF

SEQ ID NO: 11051 - protein, 241 aa, synthetic construct
  REGION 1..241: note = derived and/or modified protein sequence (wt) from HRSV__AHV81161.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESKKMAKDTSDEVSLNPTSKKLSDLLEDNDSDNDLSLDDF

SEQ ID NO: 11052 - protein, 241 aa, synthetic construct
  REGION 1..241: note = derived and/or modified protein sequence (wt) from HRSV__AHV81172.1__P
MEKFAPEFHGEDANNRATKFLESIKGKFTSPKDPKKKDSIISVNSIDIEVTKESPITSNSTIINPINETDDTVGNKPNYQRKPLVSFKEDSTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11053 - protein, 241 aa, synthetic construct
  REGION 1..241: note = derived and/or modified protein sequence (wt) from HRSV__AHV81194.1__P
MEKFAPEFHGEDANNRATKFLESIKGKFTSPKDPKKKDSIISVNSIDIEVTKESPITSNSTIINPINETDDTVGNKLNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11054 - protein, 241 aa, synthetic construct
  REGION 1..241: note = derived and/or modified protein sequence (wt) from HRSV__AHV81216.1__P
MEKFAPEFHGEDANNRATKFLESIKGKFTSPKDPKKKESIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11055 - protein, 241 aa, synthetic construct
  REGION 1..241: note = derived and/or modified protein sequence (wt) from HRSV__AHV81381.1__P
MEKFAPEFHGEDANNRATKFLESIKGKFTSPKDPKKKDSIISVNSIDIEVTKESPITSNSTIITPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVTLNPTSEKLNNLLEGNDSDNDLSLEDF

SEQ ID NO: 11056 - protein, 241 aa, synthetic construct
  REGION 1..241: note = derived and/or modified protein sequence (wt) from HRSV__AHV81832.1__P
MEKFAPEFHGEDANNKATKFLESIKGKFASSKDPKKKDSIISVNSIDIEVTKESPITSGTNIINPTSEADSTPETKTNYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11057 - protein, 241 aa, synthetic construct
  REGION 1..241: note = derived and/or modified protein sequence (wt) from HRSV__AHV81876.1__P
MEKFAPEFHGEDANNRATKFLESIKGKFTSPKDPKKKDSIISVNSIDIEVTKESPITSNSTIITPINETDDTVGNKPNHQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVTLNPTSEKLNNLLEGNDSDNDLSLEDF

SEQ ID NO: 11058 - protein, 241 aa, synthetic construct
  REGION 1..241: note = derived and/or modified protein sequence (wt) from HRSV__AHV81931.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITSRLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11059 - protein, 241 aa, synthetic construct
  REGION 1..241: note = derived and/or modified protein sequence (wt) from HRSV__AHV81964.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLKGNDSDNDLSLEDF

SEQ ID NO: 11060 - protein, 241 aa, synthetic construct
  REGION 1..241: note = derived and/or modified protein sequence (wt) from HRSV__AHV82096.1__P
MEKFAPEFHGEDANNRATKFLESIKGKFTSPKDPKKKDSIISVNSIDIEVTKESPITSNSTIIKPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11061 - protein, 241 aa, synthetic construct
  REGION 1..241: note = derived and/or modified protein sequence (wt) from HRSV__AHW80547.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITVRLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11062 - protein, 241 aa, synthetic construct
  REGION 1..241: note = derived and/or modified protein sequence (wt) from HRSV__AHW80586.1__P
MEKFAPEFHGEDANNRATKFLESIKGKFTSPKDPKKKDSIISVNSIDIEVTKESPITSNSTIINPTNETDDTSGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDKLEAMARLRNEESEKMAKDTSDEVSLNPTSEKLNNLLEGNDSDNDLSLEDF

SEQ ID NO: 11063 - protein, 241 aa, synthetic construct
  REGION 1..241: note = derived and/or modified protein sequence (wt) from HRSV__AHW80656.1__P
MEKFAPEFHGEDANNRATKFLESIKGKFTSPKDPKKKDSIISVNSIDIEVTKESPITSNSTIINPTNETDDTAGNKPNYQRKPLVSFKDDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11064 - protein, 241 aa, synthetic construct
  REGION 1..241: note = derived and/or modified protein sequence (wt) from HRSV__AHW80886.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDVELSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11065 - protein, 241 aa, synthetic construct
  REGION 1..241: note = derived and/or modified protein sequence (wt) from HRSV__AHW80966.1__P
MEKFAPEFHGEDANNRATKFLESIKGKFTSPKVPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11066 - protein, 241 aa, synthetic construct
  REGION 1..241: note = derived and/or modified protein sequence (wt) from HRSV__AHW80986.1__P
MEKFAPEFHGEDANNRATKFLESIKGKFTSPKDPKKKDSIISVNSIDIEVTKESPITSNSTIINPTNETDDTVGNKPNYQRKPLVSFKEDSTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11067 - protein, 241 aa, synthetic construct
  REGION 1..241: note = derived and/or modified protein sequence (wt) from HRSV__AHW81036.1__P
MEKFAPEFHGEDANNRATKFLESIKGKFTSPKDPKKKDSIISVNSIDIEVTKESPITSNSTIINPTNETDDTAGNKLNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11068 - protein, 241 aa, synthetic construct
  REGION 1..241: note = derived and/or modified protein sequence (wt) from HRSV__AHW81056.1__P
MEKFAPEFHGEDANNRATKFLESIKGKFTSPKDPKKKDSIISVNSIDIEVTKESPITSNSTIINPTNETDDTAENKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11069 - protein, 241 aa, synthetic construct
  REGION 1..241: note = derived and/or modified protein sequence (wt) from HRSV__AHW81176.1__P
MEKFAPEFHGEDANNRATKFLESIKGKFTSPKDPKKKDSIISVNSIDIEVTKESPITSNSTIINPTNETDDTAGNKPNYQRKPLVSFKDDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNSLLEGNDSDNDLSLEDF

SEQ ID NO: 11070 - protein, 241 aa, synthetic construct
  REGION 1..241: note = derived and/or modified protein sequence (wt) from HRSV__AHW81306.1__P
MEKFAPEFHGEDANNRATKFLESIKGKFTSPKDPKKKDSIISVNSIDIEVTKESPITSNSTIINSTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11071 - protein, 241 aa, synthetic construct
  REGION 1..241: note = derived and/or modified protein sequence (wt) from HRSV__AHW81436.1__P
MEKFAPEFHGEDANNRATKFLESIKGKFTSPKDPKKKDSIISVNSIDIEVTKESPITSNSTIINQINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11072 - protein, 241 aa, synthetic construct
  REGION 1..241: note = derived and/or modified protein sequence (wt) from HRSV__AHX56983.1__P
MEKFAPEFHGEDANNKATKFLESIKGKFASSKDPKKKDSIISVNSIDIEVTKESPITSGTNIVNPTSEADSTPETKANYPRKPLVSFKEDLTPSDNPFSKLYKETIETFDNNEEESSYSYEEINDQTNDNITVRLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11073 - protein, 241 aa, synthetic construct
  REGION 1..241: note = derived and/or modified protein sequence (wt) from HRSV__AHX57027.1__P
MEKFAPEFHGEDANNRATKFLESIKGKFTSPKDPKKKDSIISVNSIDIEVTKESPITSSSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11074 - protein, 241 aa, synthetic construct
  REGION 1..241: note = derived and/or modified protein sequence (wt) from HRSV__AHX57137.1__P
MEKFAPEFHGEDANNRATKFLESIKGKFTSPKDPKKKDSIISVNSIDIEVTKESPITSNSTIINPINETDDTVGNKPNYQRKPLVSFKEDPMPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11075 - protein, 241 aa, synthetic construct
  REGION 1..241: note = derived and/or modified protein sequence (wt) from HRSV__AHX57500.1__P
MEKFAPEFHGEDANNRATKFLESIKGKFTSPKDPKKKDSIISVNSIDIEVTKESPITSNSTIINPTNETDDTVGNKPNYQRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11076 - protein, 241 aa, synthetic construct
  REGION 1..241: note = derived and/or modified protein sequence (wt) from HRSV__AHX57511.1__P
MEKFAPEFHGEDANNKATKFLESIKGKFASSKDPKKKDSIISVNSIDIEVTKESPITSGTNIVNPTSEADSTPETKTNYPRKPLVSFKEDLTPSDNPFSKLYKETIETFDNNEEESSYSYEEINDQTNDNITVRLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11077 - protein, 241 aa, synthetic construct
  REGION 1..241: note = derived and/or modified protein sequence (wt) from HRSV__AHY21172.1__P
MEKFAPEFHGEDANNRATKFLESIKGKFTSPKDPKKKDSIISVNSIDIEVTKESPITSNSTIINPTNETDDIVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11078 - protein, 241 aa, synthetic construct
  REGION 1..241: note = derived and/or modified protein sequence (wt) from HRSV__AHY21217.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSKKLNNLLEGNDSDNDLSLEDF

SEQ ID NO: 11079 - protein, 241 aa, synthetic construct
  REGION 1..241: note = derived and/or modified protein sequence (wt) from HRSV__AHY21228.1__P
MEKFAPEFHGEDANNKATKFLESIKGKFASSKDPKKKDSIISVNSIDIEVTKESPITSGTNIINSTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11080 - protein, 241 aa, synthetic construct
  REGION 1..241: note = derived and/or modified protein sequence (wt) from HRSV__AHY21261.1__P
MEKFAPEFHGEDANNRATKFLESIKGKFTSPKDPKKKDSIISVNSIDIEVTKESPITSNSTIINPTDETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11081 - protein, 241 aa, synthetic construct
  REGION 1..241: note = derived and/or modified protein sequence (wt) from HRSV__AHY21327.1__P
MEKFAPEFHGEDANNKATKFLESIKGKFASSKDPKKKDSIISVNSIDIEVTKESPITSGTNIINPISEADSTPEAKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11082 - protein, 241 aa, synthetic construct
  REGION 1..241: note = derived and/or modified protein sequence (wt) from HRSV__AHY21371.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKDTIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11083 - protein, 241 aa, synthetic construct
  REGION 1..241: note = derived and/or modified protein sequence (wt) from HRSV__AHY21382.1__P
MEKFAPEFHGEDANNKATKFLESIKGKFASSKDPKKKDSIISVNSIDIEVTKESPITSGTNTINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11084 - protein, 241 aa, synthetic construct
  REGION 1..241: note = derived and/or modified protein sequence (wt) from HRSV__AHY21393.1__P
MEKFAPEFHGEDANNKATKFLESIKGKFASSKDPKKKDSIISVNSIDIEVTKESPITSGTNIINPINEADNTPEAKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11085 - protein, 241 aa, synthetic construct
  REGION 1..241: note = derived and/or modified protein sequence (wt) from HRSV__AHY21426.1__P
MEKFAPEFHGEDANNRATKFLESIKGKFTSPKDPKKKDSIISVNSIDIEVTKESPITSNSTIINPTNETDDTAGNKHNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11086 - protein, 241 aa, synthetic construct
  REGION 1..241: note = derived and/or modified protein sequence (wt) from HRSV__AHY21448.1__P
MEKFAPEFHGEDANNRATKFLESIKGKFTSPKDPKKKDSIISVNSIDIEVSKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11087 - protein, 241 aa, synthetic construct
  REGION 1..241: note = derived and/or modified protein sequence (wt) from HRSV__AHY21459.1__P
MEKFAPEFHGEDANNRATKFLESIKGKFTSPKDPKKKDSIISVNSIDIEVTKESPITSNSTIINPTNETDDTVGSKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11088 - protein, 241 aa, synthetic construct
  REGION 1..241: note = derived and/or modified protein sequence (wt) from HRSV__AIA62970.1__P
MEKFAPEFHGEDANNRATKFLESIKGKFTSPKDPKKKDSIISVNSTDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11089 - protein, 241 aa, synthetic construct
  REGION 1..241: note = derived and/or modified protein sequence (wt) from HRSV__AIA63540.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLRVEMIEKIRTEALMTNDRLEAMARLRNEESEKMAKDTSDEVSLNPTSEKLNNLLEGNDSDNDLSLEDF

SEQ ID NO: 11090 - protein, 241 aa, synthetic construct
  REGION 1..241: note = derived and/or modified protein sequence (wt) from HRSV__AIZ95669.1__P
MEKFAPEFHGEDANNKATKFLESIKGKFASSKDPKKKDSIISVNSIDIEVTKESPITSGTNIINPTSEADSTSETKANYPRKPLVSFKEDLTPSDNPFSKLYKETIETFDNNEEESSYSYEEINDQINDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11091 - protein, 241 aa, synthetic construct
  REGION 1..241: note = derived and/or modified protein sequence (wt) from HRSV__AIZ95933.1__P
MEKFAPEFHGEDANNRATKFLESIKGKFTSPKDPKKKDSIISVNSIDIEVTKESPITSNSTIINPTNETDDTVENKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11092 - protein, 241 aa, synthetic construct
  REGION 1..241: note = derived and/or modified protein sequence (wt) from HRSV__AJF44572.1__P
MEKFAPEFHGEDANNRATKFLESIKGKFTSPKDPKKKDSIISVNSIDIEVTKESPITSNSTIINPINETDDTLGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11093 - protein, 241 aa, synthetic construct
  REGION 1..241: note = derived and/or modified protein sequence (wt) from HRSV__AJF44634.1__P
MEKFAPEFHGEDANNKATKFLESIKGKFASTKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDDMVGLREEMIEKIRTEALMTNDRLEAMARLRNEESEKMAKDTSDEVSLNPTSEKLNNLLEGNDSDNDLSLEDF

SEQ ID NO: 11094 - protein, 241 aa, synthetic construct
  REGION 1..241: note = derived and/or modified protein sequence (wt) from HRSV__AJF44639.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEVLGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11095 - protein, 241 aa, synthetic construct
  REGION 1..241: note = derived and/or modified protein sequence (wt) from HRSV__AJF44657.1__P
MEKFAPEFHGEDANNKATKFLESIKGKFASSKDPKKKDSIISVNSIDIEITKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11096 - protein, 241 aa, synthetic construct
  REGION 1..241: note = derived and/or modified protein sequence (wt) from HRSV__AJF44672.1__P
MEKFAPEFHGEDANNRATKFLESIKGKFTSPKDPKKKDSIISVNSIDIEVTKESPITSNSTIISPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11097 - protein, 241 aa, synthetic construct
  REGION 1..241: note = derived and/or modified protein sequence (wt) from HRSV__AJF44699.1__P
MEKFAPEFHGEDANNKATKFLESIKGKFASSKDPKKKDSIISVNSIDIEVTKESPITSGTNIINPTSEADSAPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11098 - protein, 241 aa, synthetic construct
  REGION 1..241: note = derived and/or modified protein sequence (wt) from HRSV__AJF44818.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSNLLEDNDSDNDLSLDDF

SEQ ID NO: 11099 - protein, 241 aa, synthetic construct
  REGION 1..241: note = derived and/or modified protein sequence (wt) from HRSV__AJF44832.1__P
MEKFAPEFHGEDANNKATKFLESIKGKFTSTKDPKKKDSIISVNSIDIEVTKESPITSNSTIINPTNETDDTAGNKPNYQRKPLVNFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11100 - protein, 241 aa, synthetic construct
  REGION 1..241: note = derived and/or modified protein sequence (wt) from HRSV__AJZ69733.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMVKDTSDEVSLNPTSKKLSDLLEDNDSDNDLSLDDF

SEQ ID NO: 11101 - protein, 241 aa, synthetic construct
  REGION 1..241: note = derived and/or modified protein sequence (wt) from HRSV__AJZ69931.1__P
MEKFAPEFHGEDANNRATKFLESIKGKFTSPKDPKKKDSIISVNSIDIEVTKESPIISNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11102 - protein, 241 aa, synthetic construct
  REGION 1..241: note = derived and/or modified protein sequence (wt) from HRSV__AJZ70107.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDKLEAMARLRNEESEKMAKDTSDEVSLNPTSEKLNNLLEGNDSDNDLSLEDF

SEQ ID NO: 11103 - protein, 241 aa, synthetic construct
  REGION 1..241: note = derived and/or modified protein sequence (wt) from HRSV__AKS26283.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLGNEESEKMAKDTSDEVSLNPTSEKLNNLLEGNDSDNDLSLEDF

SEQ ID NO: 11104 - protein, 241 aa, synthetic construct
  REGION 1..241: note = derived and/or modified protein sequence (wt) from HRSV__AMA66345.1__P
MEKFAPEFHGEDANNRATKFLESIKGKFTSPKDPKKKDSIISVNSVDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11105 - protein, 241 aa, synthetic construct
  REGION 1..241: note = derived and/or modified protein sequence (wt) from HRSV__AMA66411.1__P
MEKFAPEFHGEDANNKATKFLESIKGKFASSKDPKKKDSIISVNSIDIEVTKESPITSGTNIINPISEADSTPEAKANYSRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11106 - protein, 241 aa, synthetic construct
  REGION 1..241: note = derived and/or modified protein sequence (wt) from HRSV__AMA66466.1__P
MEKFAPEFHGEDANNKATKFLESIKGKFASSKDPKKKDSIISVNSIDIEVTKESPITSGTNIINPTSEADSIPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVPLNPTSKKLSDLLEDNDSDNDLSLDDF

SEQ ID NO: 11107 - protein, 241 aa, synthetic construct
  REGION 1..241: note = derived and/or modified protein sequence (wt) from HRSV__AMA66477.1__P
MEKFAPEFHGEDANNRATKFLESIKGKFTSPKDPKKKDSIISVNSIDIEVTKESPITSNSTIINPTNETDDTAGNKSNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11108 - protein, 241 aa, synthetic construct
  REGION 1..241: note = derived and/or modified protein sequence (wt) from HRSV__AMA66565.1__P
MEKFAPEFHGEDANNKATKFLESIKGKFASSKDPKKKDSIISVNSIDIEVTKESPITSGTNIINPTSEADSTTETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11109 - protein, 241 aa, synthetic construct
  REGION 1..241: note = derived and/or modified protein sequence (wt) from HRSV__AMA66576.1__P
MEKFAPEFHGEDANNRATKFLESIKGKFASPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11110 - protein, 241 aa, synthetic construct
  REGION 1..241: note = derived and/or modified protein sequence (wt) from HRSV__AMA66609.1__P
MEKFAPEFHGEDANNKATKFLESIKGKFASSKDPKKKDSIISVNSIDIEVTKESPITSGTNIINPISEADNTPEAKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11111 - protein, 241 aa, synthetic construct
  REGION 1..241: note = derived and/or modified protein sequence (wt) from HRSV__AMA66983.1__P
MEKFAPEFHGEDANNRATKFLESIKGKFTSPKDPKKKDSIISVNSIDIEVTKESPITSNSTIINPANETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11112 - protein, 241 aa, synthetic construct
  REGION 1..241: note = derived and/or modified protein sequence (wt) from HRSV__AMA66994.1__P
MEKFAPEFHGEDANNRATKFLESIKGKFTSPKDPKKKDSIISVNSIDIEVTKESPITSNSTTINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11113 - protein, 241 aa, synthetic construct
  REGION 1..241: note = derived and/or modified protein sequence (wt) from HRSV__AMA67104.1__P
MEKFAPEFHGEDANNRATKFLESIKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITTRLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11114 - protein, 241 aa, synthetic construct
  REGION 1..241: note = derived and/or modified protein sequence (wt) from HRSV__AMA67236.1__P
MEKFAPEFHGEDANNKATKFLESIKGKFASSKDPKKKDSIISVNSIDIEVTKESPITSGTNIINPTSEADSTPETRANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11115 - protein, 241 aa, synthetic construct
  REGION 1..241: note = derived and/or modified protein sequence (wt) from HRSV__AMA67258.1__P
MEKFAPEFHGEDANNRATKFLESIKGKFTSPKDPKKKDSIISVNSIDIEVSKESPITSNSTIINPTNETDDTARNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11116 - protein, 241 aa, synthetic construct
  REGION 1..241: note = derived and/or modified protein sequence (wt) from HRSV__AMA67280.1__P
MEKFAPEFHGEDANNRATKFLESIKGKFTSPKDPKKKDSIISVNSIDIEVTKESPITSNSTIINPTNETDDTAGNKPNYQRKPLISFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11117 - protein, 241 aa, synthetic construct
  REGION 1..241: note = derived and/or modified protein sequence (wt) from HRSV__AMA67313.1__P
MEKFAPEFHGEDANNKATKFLESIKGKFASSKDPKKKDSIISVNSIDIEVTKESPITSGTNIINPTSEADSTPETKANYSRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11118 - protein, 241 aa, synthetic construct
  REGION 1..241: note = derived and/or modified protein sequence (wt) from HRSV__AMN91249.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGIDSDNDLSLEDF

SEQ ID NO: 11119 - protein, 241 aa, synthetic construct
  REGION 1..241: note = derived and/or modified protein sequence (wt) from HRSV__AMN91381.1__P
MEKFAPEFHGEDANNKATKFLESIKGKFASSKDPKKKDSIISVNSIDIEVTKESPITSGTNIVNPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11120 - protein, 241 aa, synthetic construct
  REGION 1..241: note = derived and/or modified protein sequence (wt) from HRSV__AMN91403.1__P
MEKFAPEFHGEDANNKATKFLESIKGKFASSKDPKKKDSIISVNSIDIEVTKESPITSGTNTINPTSEADSTPETKANYPRKPLVSFKEDLTPSDNPFSKLYKETIETFDNNEEESSYSYDEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11121 - protein, 241 aa, synthetic construct
  REGION 1..241: note = derived and/or modified protein sequence (wt) from HRSV__AMT77596.1__P
MEKFAPEFYGEDANNRATKFLESIKGKFTSPKDPKKKDSIISVNSIDIEVTKESPITSNSTIINPTNETDDTTGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11122 - protein, 241 aa, synthetic construct
  REGION 1..241: note = derived and/or modified protein sequence (wt) from HRSV__AMT77805.1__P
MEKFAPEFHGEDANNRATKFLESIKGKFTSPKDLKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11123 - protein, 241 aa, synthetic construct
  REGION 1..241: note = derived and/or modified protein sequence (wt) from HRSV__AMT77838.1__P
MEKFAPEFHGEDANNRATKFLESIKGKFTSPRDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11124 - protein, 241 aa, synthetic construct
  REGION 1..241: note = derived and/or modified protein sequence (wt) from HRSV__AMT78080.1__P
MEKFAPEFHGEDASNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11125 - protein, 241 aa, synthetic construct
  REGION 1..241: note = derived and/or modified protein sequence (wt) from HRSV__AMT78190.1__P
MEKFAPEFHGEDANNKATKFLESIKGKFASSKDPKKKDSIISVNSIDIEVTKESPITSGTNTINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPASKKLSDLLEDNDSDNDLSLDDF

SEQ ID NO: 11126 - protein, 241 aa, synthetic construct
  REGION 1..241: note = derived and/or modified protein sequence (wt) from HRSV__AMT78289.1__P
MEKFAPEFHGEDANNKATKFLESIKGKFASSKDPKKKDSIISVNSIDIEVTKESPITSGTNTINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKATSDEVSLNPTSKKLSDLLEDNDSDNDLSLDDF

SEQ ID NO: 11127 - protein, 241 aa, synthetic construct
  REGION 1..241: note = derived and/or modified protein sequence (wt) from HRSV__AMT78542.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLDGNDSDNDLSLEDF

SEQ ID NO: 11128 - protein, 241 aa, synthetic construct
  REGION 1..241: note = derived and/or modified protein sequence (wt) from HRSV__AMT78828.1__P
MEKFAPEFHGEDANNRATKFLESIKGKFTSPKDPKKKDSIISVNSIDIEVTKESPITSNSTIINQINETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11129 - protein, 241 aa, synthetic construct
  REGION 1..241: note = derived and/or modified protein sequence (wt) from HRSV__AMT78988.1__P
MEKFAPEFHGEDANNRATKFLESIKGKFTSPKEPKKKDSIISVNSIDIEVTKESPITSNSTTINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11130 - protein, 241 aa, synthetic construct
  REGION 1..241: note = derived and/or modified protein sequence (wt) from HRSV__AMT79186.1__P
MEKFAPEFHGEDANNRATKFLESIKGKFTSPKDPKKKDSIISVNSIDIEVTKESPITSNSTIINQINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDKVSLNPTSEKLNNLLEGNDSDNDLSLEDF

SEQ ID NO: 11131 - protein, 241 aa, synthetic construct
  REGION 1..241: note = derived and/or modified protein sequence (wt) from HRSV__AMT79703.1__P
MEKFAPEFHGEDANNKATKFLESIKGKFASSKDPKKKDSIISVNSIDIEVTKESPITSGTNTINPTSEADSTPETKANYPRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11132 - protein, 241 aa, synthetic construct
  REGION 1..241: note = derived and/or modified protein sequence (wt) from HRSV__AMT79934.1__P
MEKFAPEFHGEDANNKATKFLESIKGKFASSKDPKKKDSIISVNSIDIEVTKESPITSGTNTINPTSEADSTPETKANYPRKPLVSFKEDLTLSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11133 - protein, 241 aa, synthetic construct
  REGION 1..241: note = derived and/or modified protein sequence (wt) from HRSV__ANZ79656.1__P
MEKFAPEFHGEDANNRATKFLESIKGKFTSPKDPKKKDSIISVNSIDIEVTKESPITSNSTIINPTNETDDTVGNKSNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11134 - protein, 241 aa, synthetic construct
  REGION 1..241: note = derived and/or modified protein sequence (wt) from HRSV__ANZ79964.1__P
MEKFAPEFHGEDANNKATKFLESIKGKFASSKDPKKKDSIISVNSIDIEVTKESPITSGINTINPTSEADSTPETKTNYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11135 - protein, 241 aa, synthetic construct
  REGION 1..241: note = derived and/or modified protein sequence (wt) from HRSV__ANZ80151.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLERNDSDNDLSLEDF

SEQ ID NO: 11136 - protein, 241 aa, synthetic construct
  REGION 1..241: note = derived and/or modified protein sequence (wt) from HRSV__ANZ80272.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVIASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11137 - protein, 241 aa, synthetic construct
  REGION 1..241: note = derived and/or modified protein sequence (wt) from HRSV__ANZ80305.1__P
MEKFAPEFHGEDANNRATKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREELIEKIRTEALMTNDRLEAMARLRNEESEKMAKDTSDEVSLNPTSEKLNNLLEGNDSDNDLSLEDF

SEQ ID NO: 11138 - protein, 241 aa, synthetic construct
  REGION 1..241: note = derived and/or modified protein sequence (wt) from HRSV__ANZ80404.1__P
MEKFAPEFHGEDANNKATKFLESIKGKFASSKDPKKKDSIISVNSIDIEVTKESPITSGINIINPTSEADSTPETKTNYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11139 - protein, 241 aa, synthetic construct
  REGION 1..241: note = derived and/or modified protein sequence (wt) from HRSV__AOS48239.1__P
MEKFAPEFHGEDANNKATKFLESIKGKFASSKDPKKKDSIISVNSIDIEVTKESPITSGANIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11140 - protein, 241 aa, synthetic construct
  REGION 1..241: note = derived and/or modified protein sequence (wt) from HRSV__AOS48305.1__P
MEKFAPEFHGEDANNRATKFLESIKGKFTSPKDPKKKDSIISVNSIDIEVTKESPITSNSTIINPINETDDTVGNKPSYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11141 - protein, 241 aa, synthetic construct
  REGION 1..241: note = derived and/or modified protein sequence (wt) from HRSV__AOS48338.1__P
MEKFAPEFHGEDANNKATKFLESIKGKFASSKDPKKKDSIISVNSIDIEVTKESPITSSTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11142 - protein, 241 aa, synthetic construct
  REGION 1..241: note = derived and/or modified protein sequence (wt) from HRSV__AOS48349.1__P
MEKFAPEFHGEDANNKATKFLESIKGKFASSKDPKKKDSIISVNSIDIEVTKESPITSGTNIINPTSETDSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11143 - protein, 241 aa, synthetic construct
  REGION 1..241: note = derived and/or modified protein sequence (wt) from HRSV__AOS48448.1__P
MEKFAPEFHGEDANNKATKFLESIKGKFASSKDPKKKDSIISVNSIDIEVTKESPITSGTNIVNPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLKDNDSDNDLSLDDF

SEQ ID NO: 11144 - protein, 241 aa, synthetic construct
  REGION 1..241: note = derived and/or modified protein sequence (wt) from HRSV__AOS48503.1__P
MEKFAPEFHGEDANNRATKFLESIKGKFTSPKDPKKKDSIISVNSIDIEVTKESPITSSSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEENDSDNDLSLEDF

SEQ ID NO: 11145 - protein, 241 aa, synthetic construct
  REGION 1..241: note = derived and/or modified protein sequence (wt) from HRSV__AOS48580.1__P
MEKFAPEFHGEDANNKATKFLESIKGKFASSKDPKKKDSIISVNSIDIEVTKESPITSGTNIINPTSEADSTPETKASYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11146 - protein, 241 aa, synthetic construct
  REGION 1..241: note = derived and/or modified protein sequence (wt) from HRSV__AOS48734.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALTTNDRLEAMARLRNEESEKMAKDTSDEVSLNPTSKKLSDLLEDNDSDNDLSLDDF

SEQ ID NO: 11147 - protein, 241 aa, synthetic construct
  REGION 1..241: note = derived and/or modified protein sequence (wt) from HRSV__AOS48789.1__P
MEKFAPEFHGEDANNRATKFLESIKGKFTSPKDPKKKDSIISVNSIDIEVTKESPITSNSTIMNPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11148 - protein, 241 aa, synthetic construct
  REGION 1..241: note = derived and/or modified protein sequence (wt) from HRSV__AOS48888.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNIAARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11149 - protein, 241 aa, synthetic construct
  REGION 1..241: note = derived and/or modified protein sequence (wt) from HRSV__AOS49009.1__P
MEKFAPEFHGEDANNRATKFLESIKGKFTSPKDPKKKDSIISVNSIDIEVTKGSPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11150 - protein, 241 aa, synthetic construct
  REGION 1..241: note = derived and/or modified protein sequence (wt) from HRSV__AOS49031.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDKLEAMARLRNEESEKMAKDTSDEVSLNPTSKKLSDLLEDNDSDNDLSLDDF

SEQ ID NO: 11151 - protein, 241 aa, synthetic construct
  REGION 1..241: note = derived and/or modified protein sequence (wt) from HRSV__AOS49174.1__P
MEKFAPEFHGEDANNKATKFLESIKGKFASSKDPKKKDSIISVNSIDIEVTKESPITSGTNIINPTSEADSTSETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11152 - protein, 241 aa, synthetic construct
  REGION 1..241: note = derived and/or modified protein sequence (wt) from HRSV__APW29968.1__P
MEKFAPEFHGEDANNRATKFLESTKGKFTSPKDPKKKDSIISVNSIDIEVTKESPITSNSTIINPTNETDDTAGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11153 - protein, 241 aa, synthetic construct
  REGION 1..241: note = derived and/or modified protein sequence (wt) from HRSV__APW78643.1__P
MDKFAPEFHGEDANNKATKFLESIKGKFASSKDPKKKDSIISVNSIDIEVTKESPITSGTNIINPTGEADSTSETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11154 - protein, 241 aa, synthetic construct
  REGION 1..241: note = derived and/or modified protein sequence (wt) from HRSV__APW78676.1__P
MEKFAPEFHGEDANNKATKFLESIKGKFASSKDSKKKDSIISVNSIDIEVTKESPITSGTNVVNPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11155 - protein, 241 aa, synthetic construct
  REGION 1..241: note = derived and/or modified protein sequence (wt) from HRSV__APW78698.1__P
MEKFAPEFHGEDANNKATKFLESIKGKFASSKDPKKKDSIISVNSIDIEVTKESPITSGTNIINPTSEADSTPETKANYPRKPLVSFKEDLTQSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11156 - protein, 241 aa, synthetic construct
  REGION 1..241: note = derived and/or modified protein sequence (wt) from HRSV__APW78731.1__P
MEKFAPEFHGEDANNKATKFLESIKGKFASSKDPKKKDSIISVNSIDIEVTKESPITSGTNIINPTSEADSTQETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11157 - protein, 241 aa, synthetic construct
  REGION 1..241: note = derived and/or modified protein sequence (wt) from HRSV__APW78797.1__P
MEKFAPEFHGEDANNKATKFLESIKGKFASSKDPKKKDSIISVNSIDIEVTKESPITSGTNIINPTSEADSTQETKANYPRKPLVSFKEDLTPSYNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11158 - protein, 241 aa, synthetic construct
  REGION 1..241: note = derived and/or modified protein sequence (wt) from HRSV__APW78819.1__P
MEKFAPEFHGEDANNKATKFLESIKGKFASSKDPKKKDSIISVNSIDIEVTKESPITSGTNIINPISEADSTPETRANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11159 - protein, 241 aa, synthetic construct
  REGION 1..241: note = derived and/or modified protein sequence (wt) from HRSV__APW78852.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITSRLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11160 - protein, 241 aa, synthetic construct
  REGION 1..241: note = derived and/or modified protein sequence (wt) from HRSV__APW78874.1__P
MEKFAPEFHGEDANNKATKFLESIKGKFASSKDPKKKDSIISVNSIDIEVTKESPITSGTNIINPTGEADSTPETRANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11161 - protein, 241 aa, synthetic construct
  REGION 1..241: note = derived and/or modified protein sequence (wt) from HRSV__APW78896.1__P
MEKFAPEFHGEDANNKATKFLESIKGKFASSKDPKKKDSIISVNSIDIEVTKESPITSGTNIINPTSEADSTPETKANYPRKPLVSFKEDHTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11162 - protein, 241 aa, synthetic construct
  REGION 1..241: note = derived and/or modified protein sequence (wt) from HRSV__ARB07901.1__P
MEKFAPEFHGEDANNKATKFLESIKGKFASSKDPKKKDSIISVNSIDIEVIKESPITSGTNIINPTSEADSTPETKANYPRKPLVSFKEDLTPSDNPFSKLYKETIETFDNNEEESSYSYEEINDQTSDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11163 - protein, 241 aa, synthetic construct
  REGION 1..241: note = derived and/or modified protein sequence (wt) from HRSV__ARB66324.1__P
MEKFAPEFHGEDANNRATKFLESIKGKFPSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11164 - protein, 241 aa, synthetic construct
  REGION 1..241: note = derived and/or modified protein sequence (wt) from HRSV__ARN61503.1__P
MEKFAPEFHGEDANNRATKFLESIKGKFTSPKDPKKKDSIISVNSIDMEVTKESPITSNSTIINPINETDDTVGNKPNYQRKPLVSFKEDPTPSDNPFSKLYKETIETFDNNEEGSSYSYEEINDQTNDNITARLDRIDEKLSEILGMLHTLVVASAGPTSARDGIRDAMVGLREEMIEKIRTEALMTNDRLEAMARLRNEESEKVAKDTSDEVSLNPTSEKLNNLLEGNDSDNDLSLEDF

SEQ ID NO: 11165 - protein, 241 aa, synthetic construct
  REGION 1..241: note = derived and/or modified protein sequence (wt) from HRSV__ART28313.1__P
MEKFAPEFHGEDANNRATKFLESIKGKFTSPKDPKKKDSIISVNSIDIEVTKESPITSNSTIINPTNETDDTAGSKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11166 - protein, 241 aa, synthetic construct
  REGION 1..241: note = derived and/or modified protein sequence (wt) from HRSV__ART28401.1__P
MEKFAPEFHGEDANNKATKFLESIKGKFASSKDPKKKDSIISVNSIDIEVTKESPITSGTNVINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11167 - protein, 241 aa, synthetic construct
  REGION 1..241: note = derived and/or modified protein sequence (wt) from HRSV__ART28478.1__P
MEKFAPEFHGEDANNRATKFLESIKGKFTSPKDPKKKDSIISVNSIDIEATKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11168 - protein, 241 aa, synthetic construct
  REGION 1..241: note = derived and/or modified protein sequence (wt) from HRSV__ART28500.1__P
MEKFAPEFHLFHDDLFAPKFLESIKGKFTSPKDPKKKDSIISVNSIDIEVTKESPITSNSTIINPINETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11169 - protein, 241 aa, synthetic construct
  REGION 1..241: note = derived and/or modified protein sequence (wt) from HRSV__ART28544.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTTARDGIRDAMVGLREEMIEKIRAEALMTNDRLEAMARLRNEESEKMAKDTSDEVSLNPTSKKLSDLLEDNDSDNDLSLDDF

SEQ ID NO: 11170 - protein, 241 aa, synthetic construct
  REGION 1..241: note = derived and/or modified protein sequence (wt) from HRSV__ASZ84938.1__P
MEKFAPEFHGEDANNKATKFLESIKGKFASSKDPKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEGNDSDNDLSLDDF

SEQ ID NO: 11171 - protein, 241 aa, synthetic construct
  REGION 1..241: note = derived and/or modified protein sequence (wt) from HRSV__ASZ84960.1__P
MEKFAPEFHGEDANNKATKFLESIKGKFASSKDPKKKDSIISVNSIDIEVTKESPITSGTNIINPASEADSTPEPKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11172 - protein, 241 aa, synthetic construct
  REGION 1..241: note = derived and/or modified protein sequence (wt) from HRSV__ATV81328.1__P
MEKFAPEFHLFHDDLFATKFLESIKGKFTSPKDPKKKDSIISVNSIDIEVTKESPITSNSTIINPINETDDNVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11173 - protein, 241 aa, synthetic construct
  REGION 1..241: note = derived and/or modified protein sequence (wt) from HRSV__AUC68364.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGDDSDNDLSLEDF

SEQ ID NO: 11174 - protein, 241 aa, synthetic construct
  REGION 1..241: note = derived and/or modified protein sequence (wt) from HRSV__AUH15171.1__P
MEKFAPEFHGEDANNKATKFLESIKGKFASSKDHKKKDSIISVNSIDIEVTKESPITSGTNIINPTSEADSTPETKANYPRKPLVSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSDLLEDNDSDNDLSLDDF

SEQ ID NO: 11175 - protein, 241 aa, synthetic construct
  REGION 1..241: note = derived and/or modified protein sequence (wt) from HRSV__NP_044592.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREDMIEKIRTEALMTNDRLEAMARLRNEESEKMAKDTSDEVSLNPTSEKLNNLLEGNDSDNDLSLDDF

SEQ ID NO: 11176 - protein, 241 aa, synthetic construct
  REGION 1..241: note = derived and/or modified protein sequence (wt) from HRSV__P12579.1__P
MEKFAPEFHGEDANNRATKFLESIKGKFTSPKDPKKKDSIISVNSTDIEVTKESPITSNSTIINPTNETDDNAGNKPNYQRKPLVSFKEDPIPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11177 - protein, 241 aa, synthetic construct
  REGION 1..241: note = derived and/or modified protein sequence (wt) from HRSV__P14156.1__P
MEKFAPEFHGEDANNRATKFLESIKGKFTSPKDPKKKDSIISVNSIDIEVTKESPITSNSTIINPTNETDDTVGNKPNYQRKPLVSFKEDPTPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11178 - protein, 241 aa, synthetic construct
  REGION 1..241: note = derived and/or modified protein sequence (wt) from HRSV__P24567.1__P
MEKFAPEFHGEDANNKATKFLESIKGKFASSKDPKKKDSIISVNSIDIEVTKESPITSGTNIINPISEADSTPEAKANYPRKPLDSFKEDLTPSDNPFSKLYKETIETFDNNEEESSYSYEEINDQTNDNITARLDRIDEKLSEILGMLHTLVVASAGPTSARDGIRDAMVGLREEMIEKIRAEALMTNDRLEAMARLRNEESEKMAKDTSDEVSLNPTSKKLSNLLEDNDSDNDLSLDDF

SEQ ID NO: 11179 - protein, 241 aa, synthetic construct
  REGION 1..241: note = derived and/or modified protein sequence (wt) from HRSV__P33454.1__P
MEKFAPEFHGEDANTKATKFLESLKGKFTSSKDSRKKDSIISVNSIDIELPKESPITSTNHNINQPSEINDTIAANQVHIRKPLVSFKEELPSSENPFTKLYKETIETFDNNEEESSYSYDEINDQTNDNITARLDRIDEKLSEIIGMLHTLVVASAGPTAARDGIRDAMVGLREEMIEKIRSEALMTNDRLEAMARLRDEESEKMTKDTSDEVKLTPTSEKLNMVLEDESSDNDLSLEDF

SEQ ID NO: 11180 - protein, 241 aa, synthetic construct
  REGION 1..241: note = derived and/or modified protein sequence (wt) from HRSV__1512372B__P
MEKFAPEFHGEDANNRATKFLESIKGKFTSPKDPKKKDSIISVNSTDIEVTKESPITSNSTIINPTNETDDNAGNKPNYQRKPLVSFKEDPIPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKNTSDEVSLNPTSEKLNNLLEGNDSDNDLSLEDF

SEQ ID NO: 11181 - protein, 241 aa, synthetic construct
  REGION 1..241: note = derived and/or modified protein sequence (wt) from HRSV__2023379A__P
MEKFAPEFHGEDANNRATKFLESIKVKFTSPKDPKKKDSIISVNSIDIEVTKESPITSNSTIINPTNETDDNAGNKPNYQRKPLVSFKEDPIPSDNPFSKLYKETIETFDNNEEESSYSYEEINDQTNDNITARLDRIDEKLSEILGMLHTLVVASAGPTSARDGIRDAMVGLREEMIEKIRTEALMTNDRLEAMARLRNEESEKMAKDTSDEVSLNPTSEKLNNLLEGNDSDNDLSLEDF

SEQ ID NO: 11182 - protein, 241 aa, synthetic construct
  REGION 1..241: note = derived and/or modified protein sequence (wt) from HRSV__Q83956.1__P
MEKFAPEFHGEDANTKATKFLESLKGKFTSSKDSKKKDSIISVNSIDIELPKESPITSANHNISQSGENSDTPATNQVHTRKPLVSFREELPTSENPFTKLYKETIETFDNNEEESSYSYDEINDQTNDNITARLDRIDEKLSEIIGMLHTLVVASAGPTAARDGIRDAMVGLREEMIEKIRSEALMTNDRLEAMARLRNEESEKMAKDTSDDVNLNSTSEKLNTILEEDNSDNDLSLEDF

SEQ ID NO: 11183 - protein, 194 aa, synthetic construct
  REGION 1..194: note = derived and/or modified protein sequence (wt) from HRSV(A2)__P04545.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 11184 - RNA, 585 nt, synthetic construct
  misc_feature 1..585: note = derived and/or modified CDS sequence (wt) from HRSV(A2)__P04545.1__M2-1
  source 1..585: mol_type = other RNA
atgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctga

SEQ ID NO: 11185 - RNA, 585 nt, synthetic construct
  misc_feature 1..585: note = derived and/or modified CDS sequence (opt1) from HRSV(A2)__P04545.1__M2-1
  source 1..585: mol_type = other RNA
atgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctga

SEQ ID NO: 11186 - RNA, 585 nt, synthetic construct
  misc_feature 1..585: note = derived and/or modified CDS sequence (opt2) from HRSV(A2)__P04545.1__M2-1
  source 1..585: mol_type = other RNA
atgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctga

SEQ ID NO: 11187 - RNA, 585 nt, synthetic construct
  misc_feature 1..585: note = derived and/or modified CDS sequence (opt3) from HRSV(A2)__P04545.1__M2-1
  source 1..585: mol_type = other RNA
atgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctga

SEQ ID NO: 11188 - RNA, 585 nt, synthetic construct
  misc_feature 1..585: note = derived and/or modified CDS sequence (opt4) from HRSV(A2)__P04545.1__M2-1
  source 1..585: mol_type = other RNA
atgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctga

SEQ ID NO: 11189 - RNA, 585 nt, synthetic construct
  misc_feature 1..585: note = derived and/or modified CDS sequence (opt5) from HRSV(A2)__P04545.1__M2-1
  source 1..585: mol_type = other RNA
atgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatga

SEQ ID NO: 11190 - RNA, 585 nt, synthetic construct
  misc_feature 1..585: note = derived and/or modified CDS sequence (opt6) from HRSV(A2)__P04545.1__M2-1
  source 1..585: mol_type = other RNA
atgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataa

SEQ ID NO: 11191 - RNA, 585 nt, synthetic construct
  misc_feature 1..585: note = derived and/or modified CDS sequence (opt11) from HRSV(A2)__P04545.1__M2-1
  source 1..585: mol_type = other RNA
atgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctga

SEQ ID NO: 11192 - RNA, 861 nt, synthetic construct
  misc_feature 1..861: note = mRNA product Design a-1 comprising derived and/or modified sequence from HRSV(A2)__P04545.1__M2-1 (wt)
  source 1..861: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11193 - RNA, 861 nt, synthetic construct
  misc_feature 1..861: note = mRNA product Design a-1 comprising derived and/or modified sequence from HRSV(A2)__P04545.1__M2-1 (opt1)
  source 1..861: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11194 - RNA, 861 nt, synthetic construct
  misc_feature 1..861: note = mRNA product Design a-1 comprising derived and/or modified sequence from HRSV(A2)__P04545.1__M2-1 (opt2)
  source 1..861: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11195 - RNA, 861 nt, synthetic construct
  misc_feature 1..861: note = mRNA product Design a-1 comprising derived and/or modified sequence from HRSV(A2)__P04545.1__M2-1 (opt3)
  source 1..861: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11196 - RNA, 861 nt, synthetic construct
  misc_feature 1..861: note = mRNA product Design a-1 comprising derived and/or modified sequence from HRSV(A2)__P04545.1__M2-1 (opt4)
  source 1..861: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11197 - RNA, 861 nt, synthetic construct
  misc_feature 1..861: note = mRNA product Design a-1 comprising derived and/or modified sequence from HRSV(A2)__P04545.1__M2-1 (opt5)
  source 1..861: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11198 - RNA, 861 nt, synthetic construct
  misc_feature 1..861: note = mRNA product Design a-1 comprising derived and/or modified sequence from HRSV(A2)__P04545.1__M2-1 (opt6)
  source 1..861: mol_type = other RNA
gggagagtcccgcagtcggcgtccagcggctctgcttgttcgtgtgtgtgtcgttgcaggccttattcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11199 - RNA, 861 nt, synthetic construct
  misc_feature 1..861: note = mRNA product Design a-1 comprising derived and/or modified sequence from HRSV(A2)__P04545.1__M2-1 (opt11)
  source 1..861: mol_type = other RNA
gggagagtcccgcagtcggcgtccagcggctctgcttgttcgtgtgtgtgtcgttgcaggccttattcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11200 - RNA, 880 nt, synthetic construct
  misc_feature 1..880: note = mRNA product Design a-2 comprising derived and/or modified sequence from HRSV(A2)__P04545.1__M2-1 (wt)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11201 - RNA, 880 nt, synthetic construct
  misc_feature 1..880: note = mRNA product Design a-2 comprising derived and/or modified sequence from HRSV(A2)__P04545.1__M2-1 (opt1)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11202 - RNA, 880 nt, synthetic construct
  misc_feature 1..880: note = mRNA product Design a-2 comprising derived and/or modified sequence from HRSV(A2)__P04545.1__M2-1 (opt2)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11203 - RNA, 880 nt, synthetic construct
  misc_feature 1..880: note = mRNA product Design a-2 comprising derived and/or modified sequence from HRSV(A2)__P04545.1__M2-1 (opt3)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11204 - RNA, 880 nt, synthetic construct
  misc_feature 1..880: note = mRNA product Design a-2 comprising derived and/or modified sequence from HRSV(A2)__P04545.1__M2-1 (opt4)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11205 - RNA, 880 nt, synthetic construct
  misc_feature 1..880: note = mRNA product Design a-2 comprising derived and/or modified sequence from HRSV(A2)__P04545.1__M2-1 (opt5)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11206 - RNA, 880 nt, synthetic construct
  misc_feature 1..880: note = mRNA product Design a-2 comprising derived and/or modified sequence from HRSV(A2)__P04545.1__M2-1 (opt6)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11207 - RNA, 880 nt, synthetic construct
  misc_feature 1..880: note = mRNA product Design a-2 comprising derived and/or modified sequence from HRSV(A2)__P04545.1__M2-1 (opt11)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11208 - RNA, 958 nt, synthetic construct
  misc_feature 1..958: note = mRNA product Design a-3 comprising derived and/or modified sequence from HRSV(A2)__P04545.1__M2-1 (wt)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11209 - RNA, 958 nt, synthetic construct
  misc_feature 1..958: note = mRNA product Design a-3 comprising derived and/or modified sequence from HRSV(A2)__P04545.1__M2-1 (opt1)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11210 - RNA, 958 nt, synthetic construct
  misc_feature 1..958: note = mRNA product Design a-3 comprising derived and/or modified sequence from HRSV(A2)__P04545.1__M2-1 (opt2)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11211 - RNA, 958 nt, synthetic construct
  misc_feature 1..958: note = mRNA product Design a-3 comprising derived and/or modified sequence from HRSV(A2)__P04545.1__M2-1 (opt3)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11212 - RNA, 958 nt, synthetic construct
  misc_feature 1..958: note = mRNA product Design a-3 comprising derived and/or modified sequence from HRSV(A2)__P04545.1__M2-1 (opt4)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11213 - RNA, 958 nt, synthetic construct
  misc_feature 1..958: note = mRNA product Design a-3 comprising derived and/or modified sequence from HRSV(A2)__P04545.1__M2-1 (opt5)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11214 - RNA, 958 nt, synthetic construct
  misc_feature 1..958: note = mRNA product Design a-3 comprising derived and/or modified sequence from HRSV(A2)__P04545.1__M2-1 (opt6)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11215 - RNA, 958 nt, synthetic construct
  misc_feature 1..958: note = mRNA product Design a-3 comprising derived and/or modified sequence from HRSV(A2)__P04545.1__M2-1 (opt11)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11216 - RNA, 907 nt, synthetic construct
  misc_feature 1..907: note = mRNA product Design a-4 comprising derived and/or modified sequence from HRSV(A2)__P04545.1__M2-1 (wt)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11217 - RNA, 907 nt, synthetic construct
  misc_feature 1..907: note = mRNA product Design a-4 comprising derived and/or modified sequence from HRSV(A2)__P04545.1__M2-1 (opt1)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11218 - RNA, 907 nt, synthetic construct
  misc_feature 1..907: note = mRNA product Design a-4 comprising derived and/or modified sequence from HRSV(A2)__P04545.1__M2-1 (opt2)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11219 - RNA, 907 nt, synthetic construct
  misc_feature 1..907: note = mRNA product Design a-4 comprising derived and/or modified sequence from HRSV(A2)__P04545.1__M2-1 (opt3)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11220 - RNA, 907 nt, synthetic construct
  misc_feature 1..907: note = mRNA product Design a-4 comprising derived and/or modified sequence from HRSV(A2)__P04545.1__M2-1 (opt4)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11221 - RNA, 907 nt, synthetic construct
  misc_feature 1..907: note = mRNA product Design a-4 comprising derived and/or modified sequence from HRSV(A2)__P04545.1__M2-1 (opt5)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11222 - RNA, 907 nt, synthetic construct
  misc_feature 1..907: note = mRNA product Design a-4 comprising derived and/or modified sequence from HRSV(A2)__P04545.1__M2-1 (opt6)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11223 - RNA, 907 nt, synthetic construct
  misc_feature 1..907: note = mRNA product Design a-4 comprising derived and/or modified sequence from HRSV(A2)__P04545.1__M2-1 (opt11)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11224 - RNA, 853 nt, synthetic construct
  misc_feature 1..853: note = mRNA product Design a-5 comprising derived and/or modified sequence from HRSV(A2)__P04545.1__M2-1 (wt)
  source 1..853: mol_type = other RNA
gggagactttcccattctgtagcagaatttggtgttgcctgtggtcttggtcccgcggagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11225 - RNA, 853 nt, synthetic construct
  misc_feature 1..853: note = mRNA product Design a-5 comprising derived and/or modified sequence from HRSV(A2)__P04545.1__M2-1 (opt1)
  source 1..853: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11226 - RNA, 853 nt, synthetic construct
  misc_feature 1..853: note = mRNA product Design a-5 comprising derived and/or modified sequence from HRSV(A2)__P04545.1__M2-1 (opt2)
  source 1..853: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11227 - RNA, 853 nt, synthetic construct
  misc_feature 1..853: note = mRNA product Design a-5 comprising derived and/or modified sequence from HRSV(A2)__P04545.1__M2-1 (opt3)
  source 1..853: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11228 - RNA, 853 nt, synthetic construct
  misc_feature 1..853: note = mRNA product Design a-5 comprising derived and/or modified sequence from HRSV(A2)__P04545.1__M2-1 (opt4)
  source 1..853: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11229 - RNA, 853 nt, synthetic construct
  misc_feature 1..853: note = mRNA product Design a-5 comprising derived and/or modified sequence from HRSV(A2)__P04545.1__M2-1 (opt5)
  source 1..853: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11230 - RNA, 853 nt, synthetic construct
  misc_feature 1..853: note = mRNA product Design a-5 comprising derived and/or modified sequence from HRSV(A2)__P04545.1__M2-1 (opt6)
  source 1..853: mol_type = other RNA
gggagactttcccattctgtagcagaatttggtgttgcctgtggtcttggtcccgcggagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11231 - RNA, 853 nt, synthetic construct
  misc_feature 1..853: note = mRNA product Design a-5 comprising derived and/or modified sequence from HRSV(A2)__P04545.1__M2-1 (opt11)
  source 1..853: mol_type = other RNA
gggagactttcccattctgtagcagaatttggtgttgcctgtggtcttggtcccgcggagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11232 - RNA, 1034 nt, synthetic construct
  misc_feature 1..1034: note = mRNA product Design b-1 comprising derived and/or modified sequence from HRSV(A2)__P04545.1__M2-1 (wt)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11233 - RNA, 1034 nt, synthetic construct
  misc_feature 1..1034: note = mRNA product Design b-1 comprising derived and/or modified sequence from HRSV(A2)__P04545.1__M2-1 (opt1)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11234 - RNA, 1034 nt, synthetic construct
  misc_feature 1..1034: note = mRNA product Design b-1 comprising derived and/or modified sequence from HRSV(A2)__P04545.1__M2-1 (opt2)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11235 - RNA, 1034 nt, synthetic construct
  misc_feature 1..1034: note = mRNA product Design b-1 comprising derived and/or modified sequence from HRSV(A2)__P04545.1__M2-1 (opt3)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11236 - RNA, 1034 nt, synthetic construct
  misc_feature 1..1034: note = mRNA product Design b-1 comprising derived and/or modified sequence from HRSV(A2)__P04545.1__M2-1 (opt4)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11237 - RNA, 1034 nt, synthetic construct
  misc_feature 1..1034: note = mRNA product Design b-1 comprising derived and/or modified sequence from HRSV(A2)__P04545.1__M2-1 (opt5)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11238 - RNA, 1034 nt, synthetic construct
  misc_feature 1..1034: note = mRNA product Design b-1 comprising derived and/or modified sequence from HRSV(A2)__P04545.1__M2-1 (opt6)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11239 - RNA, 1034 nt, synthetic construct
  misc_feature 1..1034: note = mRNA product Design b-1 comprising derived and/or modified sequence from HRSV(A2)__P04545.1__M2-1 (opt11)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11240 - RNA, 854 nt, synthetic construct
  misc_feature 1..854: note = mRNA product Design b-2 comprising derived and/or modified sequence from HRSV(A2)__P04545.1__M2-1 (wt)
  source 1..854: mol_type = other RNA
gggagagcctctgctggagtccggggagtggcgttggctgctagagcgaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11241 - RNA, 854 nt, synthetic construct
  misc_feature 1..854: note = mRNA product Design b-2 comprising derived and/or modified sequence from HRSV(A2)__P04545.1__M2-1 (opt1)
  source 1..854: mol_type = other RNA
gggagagcctctgctggagtccggggagtggcgttggctgctagagcgaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11242 - RNA, 854 nt, synthetic construct
  misc_feature 1..854: note = mRNA product Design b-2 comprising derived and/or modified sequence from HRSV(A2)__P04545.1__M2-1 (opt2)
  source 1..854: mol_type = other RNA
gggagagcctctgctggagtccggggagtggcgttggctgctagagcgaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11243 - RNA, 854 nt, synthetic construct
  misc_feature 1..854: note = mRNA product Design b-2 comprising derived and/or modified sequence from HRSV(A2)__P04545.1__M2-1 (opt3)
  source 1..854: mol_type = other RNA
gggagagcctctgctggagtccggggagtggcgttggctgctagagcgaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11244 - RNA, 854 nt, synthetic construct
  misc_feature 1..854: note = mRNA product Design b-2 comprising derived and/or modified sequence from HRSV(A2)__P04545.1__M2-1 (opt4)
  source 1..854: mol_type = other RNA
gggagagcctctgctggagtccggggagtggcgttggctgctagagcgaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11245 - RNA, 854 nt, synthetic construct
  misc_feature 1..854: note = mRNA product Design b-2 comprising derived and/or modified sequence from HRSV(A2)__P04545.1__M2-1 (opt5)
  source 1..854: mol_type = other RNA
gggagagcctctgctggagtccggggagtggcgttggctgctagagcgaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11246 - RNA, 854 nt, synthetic construct
  misc_feature 1..854: note = mRNA product Design b-2 comprising derived and/or modified sequence from HRSV(A2)__P04545.1__M2-1 (opt6)
  source 1..854: mol_type = other RNA
gggagagcctctgctggagtccggggagtggcgttggctgctagagcgaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11247 - RNA, 854 nt, synthetic construct
  misc_feature 1..854: note = mRNA product Design b-2 comprising derived and/or modified sequence from HRSV(A2)__P04545.1__M2-1 (opt11)
  source 1..854: mol_type = other RNA
gggagagcctctgctggagtccggggagtggcgttggctgctagagcgaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11248 - RNA, 874 nt, synthetic construct
  misc_feature 1..874: note = mRNA product Design b-3 comprising derived and/or modified sequence from HRSV(A2)__P04545.1__M2-1 (wt)
  source 1..874: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11249 - RNA, 874 nt, synthetic construct
  misc_feature 1..874: note = mRNA product Design b-3 comprising derived and/or modified sequence from HRSV(A2)__P04545.1__M2-1 (opt1)
  source 1..874: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11250 - RNA, 874 nt, synthetic construct
  misc_feature 1..874: note = mRNA product Design b-3 comprising derived and/or modified sequence from HRSV(A2)__P04545.1__M2-1 (opt2)
  source 1..874: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11251 - RNA, 874 nt, synthetic construct
  misc_feature 1..874: note = mRNA product Design b-3 comprising derived and/or modified sequence from HRSV(A2)__P04545.1__M2-1 (opt3)
  source 1..874: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11252 - RNA, 874 nt, synthetic construct
  misc_feature 1..874: note = mRNA product Design b-3 comprising derived and/or modified sequence from HRSV(A2)__P04545.1__M2-1 (opt4)
  source 1..874: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11253 - RNA, 874 nt, synthetic construct
  misc_feature 1..874: note = mRNA product Design b-3 comprising derived and/or modified sequence from HRSV(A2)__P04545.1__M2-1 (opt5)
  source 1..874: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11254 - RNA, 874 nt, synthetic construct
  misc_feature 1..874: note = mRNA product Design b-3 comprising derived and/or modified sequence from HRSV(A2)__P04545.1__M2-1 (opt6)
  source 1..874: mol_type = other RNA
gggagagtcccgcagtcggcgtccagcggctctgcttgttcgtgtgtgtgtcgttgcaggccttattcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11255 - RNA, 874 nt, synthetic construct
  misc_feature 1..874: note = mRNA product Design b-3 comprising derived and/or modified sequence from HRSV(A2)__P04545.1__M2-1 (opt11)
  source 1..874: mol_type = other RNA
gggagagtcccgcagtcggcgtccagcggctctgcttgttcgtgtgtgtgtcgttgcaggccttattcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11256 - RNA, 925 nt, synthetic construct
  misc_feature 1..925: note = mRNA product Design b-4 comprising derived and/or modified sequence from HRSV(A2)__P04545.1__M2-1 (wt)
  source 1..925: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11257 - RNA, 925 nt, synthetic construct
  misc_feature 1..925: note = mRNA product Design b-4 comprising derived and/or modified sequence from HRSV(A2)__P04545.1__M2-1 (opt1)
  source 1..925: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11258 - RNA, 925 nt, synthetic construct
  misc_feature 1..925: note = mRNA product Design b-4 comprising derived and/or modified sequence from HRSV(A2)__P04545.1__M2-1 (opt2)
  source 1..925: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11259 - RNA, 925 nt, synthetic construct
  misc_feature 1..925: note = mRNA product Design b-4 comprising derived and/or modified sequence from HRSV(A2)__P04545.1__M2-1 (opt3)
  source 1..925: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11260 - RNA, 925 nt, synthetic construct
  misc_feature 1..925: note = mRNA product Design b-4 comprising derived and/or modified sequence from HRSV(A2)__P04545.1__M2-1 (opt4)
  source 1..925: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11261 - RNA, 925 nt, synthetic construct
  misc_feature 1..925: note = mRNA product Design b-4 comprising derived and/or modified sequence from HRSV(A2)__P04545.1__M2-1 (opt5)
  source 1..925: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11262 - RNA, 925 nt, synthetic construct
  misc_feature 1..925: note = mRNA product Design b-4 comprising derived and/or modified sequence from HRSV(A2)__P04545.1__M2-1 (opt6)
  source 1..925: mol_type = other RNA
gggagagtcccgcagtcggcgtccagcggctctgcttgttcgtgtgtgtgtcgttgcaggccttattcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11263 - RNA, 925 nt, synthetic construct
  misc_feature 1..925: note = mRNA product Design b-4 comprising derived and/or modified sequence from HRSV(A2)__P04545.1__M2-1 (opt11)
  source 1..925: mol_type = other RNA
gggagagtcccgcagtcggcgtccagcggctctgcttgttcgtgtgtgtgtcgttgcaggccttattcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11264 - RNA, 987 nt, synthetic construct
  misc_feature 1..987: note = mRNA product Design b-5 comprising derived and/or modified sequence from HRSV(A2)__P04545.1__M2-1 (wt)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11265 - RNA, 987 nt, synthetic construct
  misc_feature 1..987: note = mRNA product Design b-5 comprising derived and/or modified sequence from HRSV(A2)__P04545.1__M2-1 (opt1)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11266 - RNA, 987 nt, synthetic construct
  misc_feature 1..987: note = mRNA product Design b-5 comprising derived and/or modified sequence from HRSV(A2)__P04545.1__M2-1 (opt2)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11267 - RNA, 987 nt, synthetic construct
  misc_feature 1..987: note = mRNA product Design b-5 comprising derived and/or modified sequence from HRSV(A2)__P04545.1__M2-1 (opt3)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11268 - RNA, 987 nt, synthetic construct
  misc_feature 1..987: note = mRNA product Design b-5 comprising derived and/or modified sequence from HRSV(A2)__P04545.1__M2-1 (opt4)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11269 - RNA, 987 nt, synthetic construct
  misc_feature 1..987: note = mRNA product Design b-5 comprising derived and/or modified sequence from HRSV(A2)__P04545.1__M2-1 (opt5)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11270 - RNA, 987 nt, synthetic construct
  misc_feature 1..987: note = mRNA product Design b-5 comprising derived and/or modified sequence from HRSV(A2)__P04545.1__M2-1 (opt6)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11271 - RNA, 987 nt, synthetic construct
  misc_feature 1..987: note = mRNA product Design b-5 comprising derived and/or modified sequence from HRSV(A2)__P04545.1__M2-1 (opt11)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11272 - RNA, 893 nt, synthetic construct
  misc_feature 1..893: note = mRNA product Design c-1 comprising derived and/or modified sequence from HRSV(A2)__P04545.1__M2-1 (wt)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11273 - RNA, 893 nt, synthetic construct
  misc_feature 1..893: note = mRNA product Design c-1 comprising derived and/or modified sequence from HRSV(A2)__P04545.1__M2-1 (opt1)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11274 - RNA, 893 nt, synthetic construct
  misc_feature 1..893: note = mRNA product Design c-1 comprising derived and/or modified sequence from HRSV(A2)__P04545.1__M2-1 (opt2)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11275 - RNA, 893 nt, synthetic construct
  misc_feature 1..893: note = mRNA product Design c-1 comprising derived and/or modified sequence from HRSV(A2)__P04545.1__M2-1 (opt3)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11276 - RNA, 893 nt, synthetic construct
  misc_feature 1..893: note = mRNA product Design c-1 comprising derived and/or modified sequence from HRSV(A2)__P04545.1__M2-1 (opt4)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11277 - RNA, 893 nt, synthetic construct
  misc_feature 1..893: note = mRNA product Design c-1 comprising derived and/or modified sequence from HRSV(A2)__P04545.1__M2-1 (opt5)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11278 - RNA, 893 nt, synthetic construct
  misc_feature 1..893: note = mRNA product Design c-1 comprising derived and/or modified sequence from HRSV(A2)__P04545.1__M2-1 (opt6)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11279 - RNA, 893 nt, synthetic construct
  misc_feature 1..893: note = mRNA product Design c-1 comprising derived and/or modified sequence from HRSV(A2)__P04545.1__M2-1 (opt11)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11280 - RNA, 983 nt, synthetic construct
  misc_feature 1..983: note = mRNA product Design c-2 comprising derived and/or modified sequence from HRSV(A2)__P04545.1__M2-1 (wt)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11281 - RNA, 983 nt, synthetic construct
  misc_feature 1..983: note = mRNA product Design c-2 comprising derived and/or modified sequence from HRSV(A2)__P04545.1__M2-1 (opt1)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11282 - RNA, 983 nt, synthetic construct
  misc_feature 1..983: note = mRNA product Design c-2 comprising derived and/or modified sequence from HRSV(A2)__P04545.1__M2-1 (opt2)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11283 - RNA, 983 nt, synthetic construct
  misc_feature 1..983: note = mRNA product Design c-2 comprising derived and/or modified sequence from HRSV(A2)__P04545.1__M2-1 (opt3)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11284 - RNA, 983 nt, synthetic construct
  misc_feature 1..983: note = mRNA product Design c-2 comprising derived and/or modified sequence from HRSV(A2)__P04545.1__M2-1 (opt4)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11285 - RNA, 983 nt, synthetic construct
  misc_feature 1..983: note = mRNA product Design c-2 comprising derived and/or modified sequence from HRSV(A2)__P04545.1__M2-1 (opt5)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11286 - RNA, 983 nt, synthetic construct
  misc_feature 1..983: note = mRNA product Design c-2 comprising derived and/or modified sequence from HRSV(A2)__P04545.1__M2-1 (opt6)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11287 - RNA, 983 nt, synthetic construct
  misc_feature 1..983: note = mRNA product Design c-2 comprising derived and/or modified sequence from HRSV(A2)__P04545.1__M2-1 (opt11)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11288 - RNA, 960 nt, synthetic construct
  misc_feature 1..960: note = mRNA product Design c-3 comprising derived and/or modified sequence from HRSV(A2)__P04545.1__M2-1 (wt)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11289 - RNA, 960 nt, synthetic construct
  misc_feature 1..960: note = mRNA product Design c-3 comprising derived and/or modified sequence from HRSV(A2)__P04545.1__M2-1 (opt1)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11290 - RNA, 960 nt, synthetic construct
  misc_feature 1..960: note = mRNA product Design c-3 comprising derived and/or modified sequence from HRSV(A2)__P04545.1__M2-1 (opt2)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11291 - RNA, 960 nt, synthetic construct
  misc_feature 1..960: note = mRNA product Design c-3 comprising derived and/or modified sequence from HRSV(A2)__P04545.1__M2-1 (opt3)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11292 - RNA, 960 nt, synthetic construct
  misc_feature 1..960: note = mRNA product Design c-3 comprising derived and/or modified sequence from HRSV(A2)__P04545.1__M2-1 (opt4)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11293 - RNA, 960 nt, synthetic construct
  misc_feature 1..960: note = mRNA product Design c-3 comprising derived and/or modified sequence from HRSV(A2)__P04545.1__M2-1 (opt5)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11294 - RNA, 960 nt, synthetic construct
  misc_feature 1..960: note = mRNA product Design c-3 comprising derived and/or modified sequence from HRSV(A2)__P04545.1__M2-1 (opt6)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11295 - RNA, 960 nt, synthetic construct
  misc_feature 1..960: note = mRNA product Design c-3 comprising derived and/or modified sequence from HRSV(A2)__P04545.1__M2-1 (opt11)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11296 - RNA, 956 nt, synthetic construct
  misc_feature 1..956: note = mRNA product Design c-4 comprising derived and/or modified sequence from HRSV(A2)__P04545.1__M2-1 (wt)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11297 - RNA, 956 nt, synthetic construct
  misc_feature 1..956: note = mRNA product Design c-4 comprising derived and/or modified sequence from HRSV(A2)__P04545.1__M2-1 (opt1)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11298 - RNA, 956 nt, synthetic construct
  misc_feature 1..956: note = mRNA product Design c-4 comprising derived and/or modified sequence from HRSV(A2)__P04545.1__M2-1 (opt2)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11299 - RNA, 956 nt, synthetic construct
  misc_feature 1..956: note = mRNA product Design c-4 comprising derived and/or modified sequence from HRSV(A2)__P04545.1__M2-1 (opt3)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11300 - RNA, 956 nt, synthetic construct
  misc_feature 1..956: note = mRNA product Design c-4 comprising derived and/or modified sequence from HRSV(A2)__P04545.1__M2-1 (opt4)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11301 - RNA, 956 nt, synthetic construct
  misc_feature 1..956: note = mRNA product Design c-4 comprising derived and/or modified sequence from HRSV(A2)__P04545.1__M2-1 (opt5)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11302 - RNA, 956 nt, synthetic construct
  misc_feature 1..956: note = mRNA product Design c-4 comprising derived and/or modified sequence from HRSV(A2)__P04545.1__M2-1 (opt6)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11303 - RNA, 956 nt, synthetic construct
  misc_feature 1..956: note = mRNA product Design c-4 comprising derived and/or modified sequence from HRSV(A2)__P04545.1__M2-1 (opt11)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11304 - RNA, 874 nt, synthetic construct
  misc_feature 1..874: note = mRNA product Design c-5 comprising derived and/or modified sequence from HRSV(A2)__P04545.1__M2-1 (wt)
  source 1..874: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11305 - RNA, 874 nt, synthetic construct
  misc_feature 1..874: note = mRNA product Design c-5 comprising derived and/or modified sequence from HRSV(A2)__P04545.1__M2-1 (opt1)
  source 1..874: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11306 - RNA, 874 nt, synthetic construct
  misc_feature 1..874: note = mRNA product Design c-5 comprising derived and/or modified sequence from HRSV(A2)__P04545.1__M2-1 (opt2)
  source 1..874: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11307 - RNA, 874 nt, synthetic construct
  misc_feature 1..874: note = mRNA product Design c-5 comprising derived and/or modified sequence from HRSV(A2)__P04545.1__M2-1 (opt3)
  source 1..874: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11308 - RNA, 874 nt, synthetic construct
  misc_feature 1..874: note = mRNA product Design c-5 comprising derived and/or modified sequence from HRSV(A2)__P04545.1__M2-1 (opt4)
  source 1..874: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11309 - RNA, 874 nt, synthetic construct
  misc_feature 1..874: note = mRNA product Design c-5 comprising derived and/or modified sequence from HRSV(A2)__P04545.1__M2-1 (opt5)
  source 1..874: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11310 - RNA, 874 nt, synthetic construct
  misc_feature 1..874: note = mRNA product Design c-5 comprising derived and/or modified sequence from HRSV(A2)__P04545.1__M2-1 (opt6)
  source 1..874: mol_type = other RNA
gggagagcggctcggccattttgtcccagtcagtccggaggctgcggctgcagaagtaccgcctgcggagtaactgcaaagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11311 - RNA, 874 nt, synthetic construct
  misc_feature 1..874: note = mRNA product Design c-5 comprising derived and/or modified sequence from HRSV(A2)__P04545.1__M2-1 (opt11)
  source 1..874: mol_type = other RNA
gggagagcggctcggccattttgtcccagtcagtccggaggctgcggctgcagaagtaccgcctgcggagtaactgcaaagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11312 - RNA, 883 nt, synthetic construct
  misc_feature 1..883: note = mRNA product Design d-1 comprising derived and/or modified sequence from HRSV(A2)__P04545.1__M2-1 (wt)
  source 1..883: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11313 - RNA, 883 nt, synthetic construct
  misc_feature 1..883: note = mRNA product Design d-1 comprising derived and/or modified sequence from HRSV(A2)__P04545.1__M2-1 (opt1)
  source 1..883: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11314 - RNA, 883 nt, synthetic construct
  misc_feature 1..883: note = mRNA product Design d-1 comprising derived and/or modified sequence from HRSV(A2)__P04545.1__M2-1 (opt2)
  source 1..883: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11315 - RNA, 883 nt, synthetic construct
  misc_feature 1..883: note = mRNA product Design d-1 comprising derived and/or modified sequence from HRSV(A2)__P04545.1__M2-1 (opt3)
  source 1..883: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11316 - RNA, 883 nt, synthetic construct
  misc_feature 1..883: note = mRNA product Design d-1 comprising derived and/or modified sequence from HRSV(A2)__P04545.1__M2-1 (opt4)
  source 1..883: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11317 - RNA, 883 nt, synthetic construct
  misc_feature 1..883: note = mRNA product Design d-1 comprising derived and/or modified sequence from HRSV(A2)__P04545.1__M2-1 (opt5)
  source 1..883: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11318 - RNA, 883 nt, synthetic construct
  misc_feature 1..883: note = mRNA product Design d-1 comprising derived and/or modified sequence from HRSV(A2)__P04545.1__M2-1 (opt6)
  source 1..883: mol_type = other RNA
gggagacccgtgacccggaagttgtacggctacgcgactttccctcccacaaaccctcgcgcccttcctttcctacttgggcccggcagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11319 - RNA, 883 nt, synthetic construct
  misc_feature 1..883: note = mRNA product Design d-1 comprising derived and/or modified sequence from HRSV(A2)__P04545.1__M2-1 (opt11)
  source 1..883: mol_type = other RNA
gggagacccgtgacccggaagttgtacggctacgcgactttccctcccacaaaccctcgcgcccttcctttcctacttgggcccggcagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11320 - RNA, 938 nt, synthetic construct
  misc_feature 1..938: note = mRNA product Design d-2 comprising derived and/or modified sequence from HRSV(A2)__P04545.1__M2-1 (wt)
  source 1..938: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11321 - RNA, 938 nt, synthetic construct
  misc_feature 1..938: note = mRNA product Design d-2 comprising derived and/or modified sequence from HRSV(A2)__P04545.1__M2-1 (opt1)
  source 1..938: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11322 - RNA, 938 nt, synthetic construct
  misc_feature 1..938: note = mRNA product Design d-2 comprising derived and/or modified sequence from HRSV(A2)__P04545.1__M2-1 (opt2)
  source 1..938: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11323 - RNA, 938 nt, synthetic construct
  misc_feature 1..938: note = mRNA product Design d-2 comprising derived and/or modified sequence from HRSV(A2)__P04545.1__M2-1 (opt3)
  source 1..938: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11324 - RNA, 938 nt, synthetic construct
  misc_feature 1..938: note = mRNA product Design d-2 comprising derived and/or modified sequence from HRSV(A2)__P04545.1__M2-1 (opt4)
  source 1..938: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11325 - RNA, 938 nt, synthetic construct
  misc_feature 1..938: note = mRNA product Design d-2 comprising derived and/or modified sequence from HRSV(A2)__P04545.1__M2-1 (opt5)
  source 1..938: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11326 - RNA, 938 nt, synthetic construct
  misc_feature 1..938: note = mRNA product Design d-2 comprising derived and/or modified sequence from HRSV(A2)__P04545.1__M2-1 (opt6)
  source 1..938: mol_type = other RNA
gggagagcggctcggccattttgtcccagtcagtccggaggctgcggctgcagaagtaccgcctgcggagtaactgcaaagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11327 - RNA, 938 nt, synthetic construct
  misc_feature 1..938: note = mRNA product Design d-2 comprising derived and/or modified sequence from HRSV(A2)__P04545.1__M2-1 (opt11)
  source 1..938: mol_type = other RNA
gggagagcggctcggccattttgtcccagtcagtccggaggctgcggctgcagaagtaccgcctgcggagtaactgcaaagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11328 - RNA, 1254 nt, synthetic construct
  misc_feature 1..1254: note = mRNA product Design d-3 comprising derived and/or modified sequence from HRSV(A2)__P04545.1__M2-1 (wt)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11329 - RNA, 1254 nt, synthetic construct
  misc_feature 1..1254: note = mRNA product Design d-3 comprising derived and/or modified sequence from HRSV(A2)__P04545.1__M2-1 (opt1)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11330 - RNA, 1254 nt, synthetic construct
  misc_feature 1..1254: note = mRNA product Design d-3 comprising derived and/or modified sequence from HRSV(A2)__P04545.1__M2-1 (opt2)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11331 - RNA, 1254 nt, synthetic construct
  misc_feature 1..1254: note = mRNA product Design d-3 comprising derived and/or modified sequence from HRSV(A2)__P04545.1__M2-1 (opt3)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11332 - RNA, 1254 nt, synthetic construct
  misc_feature 1..1254: note = mRNA product Design d-3 comprising derived and/or modified sequence from HRSV(A2)__P04545.1__M2-1 (opt4)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11333 - RNA, 1254 nt, synthetic construct
  misc_feature 1..1254: note = mRNA product Design d-3 comprising derived and/or modified sequence from HRSV(A2)__P04545.1__M2-1 (opt5)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11334 - RNA, 1254 nt, synthetic construct
  misc_feature 1..1254: note = mRNA product Design d-3 comprising derived and/or modified sequence from HRSV(A2)__P04545.1__M2-1 (opt6)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11335 - RNA, 1254 nt, synthetic construct
  misc_feature 1..1254: note = mRNA product Design d-3 comprising derived and/or modified sequence from HRSV(A2)__P04545.1__M2-1 (opt11)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11336 - RNA, 937 nt, synthetic construct
  misc_feature 1..937: note = mRNA product Design d-4 comprising derived and/or modified sequence from HRSV(A2)__P04545.1__M2-1 (wt)
  source 1..937: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11337 - RNA, 937 nt, synthetic construct
  misc_feature 1..937: note = mRNA product Design d-4 comprising derived and/or modified sequence from HRSV(A2)__P04545.1__M2-1 (opt1)
  source 1..937: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11338 - RNA, 937 nt, synthetic construct
  misc_feature 1..937: note = mRNA product Design d-4 comprising derived and/or modified sequence from HRSV(A2)__P04545.1__M2-1 (opt2)
  source 1..937: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11339 - RNA, 937 nt, synthetic construct
  misc_feature 1..937: note = mRNA product Design d-4 comprising derived and/or modified sequence from HRSV(A2)__P04545.1__M2-1 (opt3)
  source 1..937: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11340 - RNA, 937 nt, synthetic construct
  misc_feature 1..937: note = mRNA product Design d-4 comprising derived and/or modified sequence from HRSV(A2)__P04545.1__M2-1 (opt4)
  source 1..937: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11341 - RNA, 937 nt, synthetic construct
  misc_feature 1..937: note = mRNA product Design d-4 comprising derived and/or modified sequence from HRSV(A2)__P04545.1__M2-1 (opt5)
  source 1..937: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11342 - RNA, 937 nt, synthetic construct
  misc_feature 1..937: note = mRNA product Design d-4 comprising derived and/or modified sequence from HRSV(A2)__P04545.1__M2-1 (opt6)
  source 1..937: mol_type = other RNA
gggagagtcccgcagtcggcgtccagcggctctgcttgttcgtgtgtgtgtcgttgcaggccttattcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11343 - RNA, 937 nt, synthetic construct
  misc_feature 1..937: note = mRNA product Design d-4 comprising derived and/or modified sequence from HRSV(A2)__P04545.1__M2-1 (opt11)
  source 1..937: mol_type = other RNA
gggagagtcccgcagtcggcgtccagcggctctgcttgttcgtgtgtgtgtcgttgcaggccttattcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11344 - RNA, 1034 nt, synthetic construct
  misc_feature 1..1034: note = mRNA product Design d-5 comprising derived and/or modified sequence from HRSV(A2)__P04545.1__M2-1 (wt)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11345 - RNA, 1034 nt, synthetic construct
  misc_feature 1..1034: note = mRNA product Design d-5 comprising derived and/or modified sequence from HRSV(A2)__P04545.1__M2-1 (opt1)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11346 - RNA, 1034 nt, synthetic construct
  misc_feature 1..1034: note = mRNA product Design d-5 comprising derived and/or modified sequence from HRSV(A2)__P04545.1__M2-1 (opt2)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11347 - RNA, 1034 nt, synthetic construct
  misc_feature 1..1034: note = mRNA product Design d-5 comprising derived and/or modified sequence from HRSV(A2)__P04545.1__M2-1 (opt3)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11348 - RNA, 1034 nt, synthetic construct
  misc_feature 1..1034: note = mRNA product Design d-5 comprising derived and/or modified sequence from HRSV(A2)__P04545.1__M2-1 (opt4)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11349 - RNA, 1034 nt, synthetic construct
  misc_feature 1..1034: note = mRNA product Design d-5 comprising derived and/or modified sequence from HRSV(A2)__P04545.1__M2-1 (opt5)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11350 - RNA, 1034 nt, synthetic construct
  misc_feature 1..1034: note = mRNA product Design d-5 comprising derived and/or modified sequence from HRSV(A2)__P04545.1__M2-1 (opt6)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11351 - RNA, 1034 nt, synthetic construct
  misc_feature 1..1034: note = mRNA product Design d-5 comprising derived and/or modified sequence from HRSV(A2)__P04545.1__M2-1 (opt11)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11352 - RNA, 914 nt, synthetic construct
  misc_feature 1..914: note = mRNA product Design e-1 comprising derived and/or modified sequence from HRSV(A2)__P04545.1__M2-1 (wt)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11353 - RNA, 914 nt, synthetic construct
  misc_feature 1..914: note = mRNA product Design e-1 comprising derived and/or modified sequence from HRSV(A2)__P04545.1__M2-1 (opt1)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11354 - RNA, 914 nt, synthetic construct
  misc_feature 1..914: note = mRNA product Design e-1 comprising derived and/or modified sequence from HRSV(A2)__P04545.1__M2-1 (opt2)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11355 - RNA, 914 nt, synthetic construct
  misc_feature 1..914: note = mRNA product Design e-1 comprising derived and/or modified sequence from HRSV(A2)__P04545.1__M2-1 (opt3)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11356 - RNA, 914 nt, synthetic construct
  misc_feature 1..914: note = mRNA product Design e-1 comprising derived and/or modified sequence from HRSV(A2)__P04545.1__M2-1 (opt4)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11357 - RNA, 914 nt, synthetic construct
  misc_feature 1..914: note = mRNA product Design e-1 comprising derived and/or modified sequence from HRSV(A2)__P04545.1__M2-1 (opt5)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11358 - RNA, 914 nt, synthetic construct
  misc_feature 1..914: note = mRNA product Design e-1 comprising derived and/or modified sequence from HRSV(A2)__P04545.1__M2-1 (opt6)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11359 - RNA, 914 nt, synthetic construct
  misc_feature 1..914: note = mRNA product Design e-1 comprising derived and/or modified sequence from HRSV(A2)__P04545.1__M2-1 (opt11)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11360 - RNA, 896 nt, synthetic construct
  misc_feature 1..896: note = mRNA product Design e-2 comprising derived and/or modified sequence from HRSV(A2)__P04545.1__M2-1 (wt)
  source 1..896: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11361 - RNA, 896 nt, synthetic construct
  misc_feature 1..896: note = mRNA product Design e-2 comprising derived and/or modified sequence from HRSV(A2)__P04545.1__M2-1 (opt1)
  source 1..896: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11362 - RNA, 896 nt, synthetic construct
  misc_feature 1..896: note = mRNA product Design e-2 comprising derived and/or modified sequence from HRSV(A2)__P04545.1__M2-1 (opt2)
  source 1..896: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11363 - RNA, 896 nt, synthetic construct
  misc_feature 1..896: note = mRNA product Design e-2 comprising derived and/or modified sequence from HRSV(A2)__P04545.1__M2-1 (opt3)
  source 1..896: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11364 - RNA, 896 nt, synthetic construct
  misc_feature 1..896: note = mRNA product Design e-2 comprising derived and/or modified sequence from HRSV(A2)__P04545.1__M2-1 (opt4)
  source 1..896: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11365 - RNA, 896 nt, synthetic construct
  misc_feature 1..896: note = mRNA product Design e-2 comprising derived and/or modified sequence from HRSV(A2)__P04545.1__M2-1 (opt5)
  source 1..896: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11366 - RNA, 896 nt, synthetic construct
  misc_feature 1..896: note = mRNA product Design e-2 comprising derived and/or modified sequence from HRSV(A2)__P04545.1__M2-1 (opt6)
  source 1..896: mol_type = other RNA
gggagacccgtgacccggaagttgtacggctacgcgactttccctcccacaaaccctcgcgcccttcctttcctacttgggcccggcagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11367 - RNA, 896 nt, synthetic construct
  misc_feature 1..896: note = mRNA product Design e-2 comprising derived and/or modified sequence from HRSV(A2)__P04545.1__M2-1 (opt11)
  source 1..896: mol_type = other RNA
gggagacccgtgacccggaagttgtacggctacgcgactttccctcccacaaaccctcgcgcccttcctttcctacttgggcccggcagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11368 - RNA, 866 nt, synthetic construct
  misc_feature 1..866: note = mRNA product Design e-3 comprising derived and/or modified sequence from HRSV(A2)__P04545.1__M2-1 (wt)
  source 1..866: mol_type = other RNA
gggagactttcccattctgtagcagaatttggtgttgcctgtggtcttggtcccgcggagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11369 - RNA, 866 nt, synthetic construct
  misc_feature 1..866: note = mRNA product Design e-3 comprising derived and/or modified sequence from HRSV(A2)__P04545.1__M2-1 (opt1)
  source 1..866: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11370 - RNA, 866 nt, synthetic construct
  misc_feature 1..866: note = mRNA product Design e-3 comprising derived and/or modified sequence from HRSV(A2)__P04545.1__M2-1 (opt2)
  source 1..866: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11371 - RNA, 866 nt, synthetic construct
  misc_feature 1..866: note = mRNA product Design e-3 comprising derived and/or modified sequence from HRSV(A2)__P04545.1__M2-1 (opt3)
  source 1..866: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11372 - RNA, 866 nt, synthetic construct
  misc_feature 1..866: note = mRNA product Design e-3 comprising derived and/or modified sequence from HRSV(A2)__P04545.1__M2-1 (opt4)
  source 1..866: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11373 - RNA, 866 nt, synthetic construct
  misc_feature 1..866: note = mRNA product Design e-3 comprising derived and/or modified sequence from HRSV(A2)__P04545.1__M2-1 (opt5)
  source 1..866: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11374 - RNA, 866 nt, synthetic construct
  misc_feature 1..866: note = mRNA product Design e-3 comprising derived and/or modified sequence from HRSV(A2)__P04545.1__M2-1 (opt6)
  source 1..866: mol_type = other RNA
gggagactttcccattctgtagcagaatttggtgttgcctgtggtcttggtcccgcggagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11375 - RNA, 866 nt, synthetic construct
  misc_feature 1..866: note = mRNA product Design e-3 comprising derived and/or modified sequence from HRSV(A2)__P04545.1__M2-1 (opt11)
  source 1..866: mol_type = other RNA
gggagactttcccattctgtagcagaatttggtgttgcctgtggtcttggtcccgcggagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11376 - RNA, 920 nt, synthetic construct
  misc_feature 1..920: note = mRNA product Design e-4 comprising derived and/or modified sequence from HRSV(A2)__P04545.1__M2-1 (wt)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11377 - RNA, 920 nt, synthetic construct
  misc_feature 1..920: note = mRNA product Design e-4 comprising derived and/or modified sequence from HRSV(A2)__P04545.1__M2-1 (opt1)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11378 - RNA, 920 nt, synthetic construct
  misc_feature 1..920: note = mRNA product Design e-4 comprising derived and/or modified sequence from HRSV(A2)__P04545.1__M2-1 (opt2)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11379 - RNA, 920 nt, synthetic construct
  misc_feature 1..920: note = mRNA product Design e-4 comprising derived and/or modified sequence from HRSV(A2)__P04545.1__M2-1 (opt3)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11380 - RNA, 920 nt, synthetic construct
  misc_feature 1..920: note = mRNA product Design e-4 comprising derived and/or modified sequence from HRSV(A2)__P04545.1__M2-1 (opt4)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11381 - RNA, 920 nt, synthetic construct
  misc_feature 1..920: note = mRNA product Design e-4 comprising derived and/or modified sequence from HRSV(A2)__P04545.1__M2-1 (opt5)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11382 - RNA, 920 nt, synthetic construct
  misc_feature 1..920: note = mRNA product Design e-4 comprising derived and/or modified sequence from HRSV(A2)__P04545.1__M2-1 (opt6)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11383 - RNA, 920 nt, synthetic construct
  misc_feature 1..920: note = mRNA product Design e-4 comprising derived and/or modified sequence from HRSV(A2)__P04545.1__M2-1 (opt11)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11384 - RNA, 887 nt, synthetic construct
  misc_feature 1..887: note = mRNA product Design e-5 comprising derived and/or modified sequence from HRSV(A2)__P04545.1__M2-1 (wt)
  source 1..887: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11385 - RNA, 887 nt, synthetic construct
  misc_feature 1..887: note = mRNA product Design e-5 comprising derived and/or modified sequence from HRSV(A2)__P04545.1__M2-1 (opt1)
  source 1..887: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11386 - RNA, 887 nt, synthetic construct
  misc_feature 1..887: note = mRNA product Design e-5 comprising derived and/or modified sequence from HRSV(A2)__P04545.1__M2-1 (opt2)
  source 1..887: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11387 - RNA, 887 nt, synthetic construct
  misc_feature 1..887: note = mRNA product Design e-5 comprising derived and/or modified sequence from HRSV(A2)__P04545.1__M2-1 (opt3)
  source 1..887: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11388 - RNA, 887 nt, synthetic construct
  misc_feature 1..887: note = mRNA product Design e-5 comprising derived and/or modified sequence from HRSV(A2)__P04545.1__M2-1 (opt4)
  source 1..887: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11389 - RNA, 887 nt, synthetic construct
  misc_feature 1..887: note = mRNA product Design e-5 comprising derived and/or modified sequence from HRSV(A2)__P04545.1__M2-1 (opt5)
  source 1..887: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11390 - RNA, 887 nt, synthetic construct
  misc_feature 1..887: note = mRNA product Design e-5 comprising derived and/or modified sequence from HRSV(A2)__P04545.1__M2-1 (opt6)
  source 1..887: mol_type = other RNA
gggagagcggctcggccattttgtcccagtcagtccggaggctgcggctgcagaagtaccgcctgcggagtaactgcaaagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11391 - RNA, 887 nt, synthetic construct
  misc_feature 1..887: note = mRNA product Design e-5 comprising derived and/or modified sequence from HRSV(A2)__P04545.1__M2-1 (opt11)
  source 1..887: mol_type = other RNA
gggagagcggctcggccattttgtcccagtcagtccggaggctgcggctgcagaagtaccgcctgcggagtaactgcaaagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11392 - RNA, 954 nt, synthetic construct
  misc_feature 1..954: note = mRNA product Design e-6 comprising derived and/or modified sequence from HRSV(A2)__P04545.1__M2-1 (wt)
  source 1..954: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11393 - RNA, 954 nt, synthetic construct
  misc_feature 1..954: note = mRNA product Design e-6 comprising derived and/or modified sequence from HRSV(A2)__P04545.1__M2-1 (opt1)
  source 1..954: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11394 - RNA, 954 nt, synthetic construct
  misc_feature 1..954: note = mRNA product Design e-6 comprising derived and/or modified sequence from HRSV(A2)__P04545.1__M2-1 (opt2)
  source 1..954: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11395 - RNA, 954 nt, synthetic construct
  misc_feature 1..954: note = mRNA product Design e-6 comprising derived and/or modified sequence from HRSV(A2)__P04545.1__M2-1 (opt3)
  source 1..954: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11396 - RNA, 954 nt, synthetic construct
  misc_feature 1..954: note = mRNA product Design e-6 comprising derived and/or modified sequence from HRSV(A2)__P04545.1__M2-1 (opt4)
  source 1..954: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11397 - RNA, 954 nt, synthetic construct
  misc_feature 1..954: note = mRNA product Design e-6 comprising derived and/or modified sequence from HRSV(A2)__P04545.1__M2-1 (opt5)
  source 1..954: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11398 - RNA, 954 nt, synthetic construct
  misc_feature 1..954: note = mRNA product Design e-6 comprising derived and/or modified sequence from HRSV(A2)__P04545.1__M2-1 (opt6)
  source 1..954: mol_type = other RNA
gggagagcggctcggccattttgtcccagtcagtccggaggctgcggctgcagaagtaccgcctgcggagtaactgcaaagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11399 - RNA, 954 nt, synthetic construct
  misc_feature 1..954: note = mRNA product Design e-6 comprising derived and/or modified sequence from HRSV(A2)__P04545.1__M2-1 (opt11)
  source 1..954: mol_type = other RNA
gggagagcggctcggccattttgtcccagtcagtccggaggctgcggctgcagaagtaccgcctgcggagtaactgcaaagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11400 - RNA, 1170 nt, synthetic construct
  misc_feature 1..1170: note = mRNA product Design f-1 comprising derived and/or modified sequence from HRSV(A2)__P04545.1__M2-1 (wt)
  source 1..1170: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11401 - RNA, 1170 nt, synthetic construct
  misc_feature 1..1170: note = mRNA product Design f-1 comprising derived and/or modified sequence from HRSV(A2)__P04545.1__M2-1 (opt1)
  source 1..1170: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11402 - RNA, 1170 nt, synthetic construct
  misc_feature 1..1170: note = mRNA product Design f-1 comprising derived and/or modified sequence from HRSV(A2)__P04545.1__M2-1 (opt2)
  source 1..1170: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11403 - RNA, 1170 nt, synthetic construct
  misc_feature 1..1170: note = mRNA product Design f-1 comprising derived and/or modified sequence from HRSV(A2)__P04545.1__M2-1 (opt3)
  source 1..1170: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11404 - RNA, 1170 nt, synthetic construct
  misc_feature 1..1170: note = mRNA product Design f-1 comprising derived and/or modified sequence from HRSV(A2)__P04545.1__M2-1 (opt4)
  source 1..1170: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11405 - RNA, 1170 nt, synthetic construct
  misc_feature 1..1170: note = mRNA product Design f-1 comprising derived and/or modified sequence from HRSV(A2)__P04545.1__M2-1 (opt5)
  source 1..1170: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11406 - RNA, 1170 nt, synthetic construct
  misc_feature 1..1170: note = mRNA product Design f-1 comprising derived and/or modified sequence from HRSV(A2)__P04545.1__M2-1 (opt6)
  source 1..1170: mol_type = other RNA
gggagagcggctcggccattttgtcccagtcagtccggaggctgcggctgcagaagtaccgcctgcggagtaactgcaaagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11407 - RNA, 1170 nt, synthetic construct
  misc_feature 1..1170: note = mRNA product Design f-1 comprising derived and/or modified sequence from HRSV(A2)__P04545.1__M2-1 (opt11)
  source 1..1170: mol_type = other RNA
gggagagcggctcggccattttgtcccagtcagtccggaggctgcggctgcagaagtaccgcctgcggagtaactgcaaagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11408 - RNA, 950 nt, synthetic construct
  misc_feature 1..950: note = mRNA product Design f-2 comprising derived and/or modified sequence from HRSV(A2)__P04545.1__M2-1 (wt)
  source 1..950: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11409 - RNA, 950 nt, synthetic construct
  misc_feature 1..950: note = mRNA product Design f-2 comprising derived and/or modified sequence from HRSV(A2)__P04545.1__M2-1 (opt1)
  source 1..950: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11410 - RNA, 950 nt, synthetic construct
  misc_feature 1..950: note = mRNA product Design f-2 comprising derived and/or modified sequence from HRSV(A2)__P04545.1__M2-1 (opt2)
  source 1..950: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11411 - RNA, 950 nt, synthetic construct
  misc_feature 1..950: note = mRNA product Design f-2 comprising derived and/or modified sequence from HRSV(A2)__P04545.1__M2-1 (opt3)
  source 1..950: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11412 - RNA, 950 nt, synthetic construct
  misc_feature 1..950: note = mRNA product Design f-2 comprising derived and/or modified sequence from HRSV(A2)__P04545.1__M2-1 (opt4)
  source 1..950: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11413 - RNA, 950 nt, synthetic construct
  misc_feature 1..950: note = mRNA product Design f-2 comprising derived and/or modified sequence from HRSV(A2)__P04545.1__M2-1 (opt5)
  source 1..950: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11414 - RNA, 950 nt, synthetic construct
  misc_feature 1..950: note = mRNA product Design f-2 comprising derived and/or modified sequence from HRSV(A2)__P04545.1__M2-1 (opt6)
  source 1..950: mol_type = other RNA
gggagagcggctcggccattttgtcccagtcagtccggaggctgcggctgcagaagtaccgcctgcggagtaactgcaaagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11415 - RNA, 950 nt, synthetic construct
  misc_feature 1..950: note = mRNA product Design f-2 comprising derived and/or modified sequence from HRSV(A2)__P04545.1__M2-1 (opt11)
  source 1..950: mol_type = other RNA
gggagagcggctcggccattttgtcccagtcagtccggaggctgcggctgcagaagtaccgcctgcggagtaactgcaaagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11416 - RNA, 941 nt, synthetic construct
  misc_feature 1..941: note = mRNA product Design f-3 comprising derived and/or modified sequence from HRSV(A2)__P04545.1__M2-1 (wt)
  source 1..941: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11417 - RNA, 941 nt, synthetic construct
  misc_feature 1..941: note = mRNA product Design f-3 comprising derived and/or modified sequence from HRSV(A2)__P04545.1__M2-1 (opt1)
  source 1..941: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11418 - RNA, 941 nt, synthetic construct
  misc_feature 1..941: note = mRNA product Design f-3 comprising derived and/or modified sequence from HRSV(A2)__P04545.1__M2-1 (opt2)
  source 1..941: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11419 - RNA, 941 nt, synthetic construct
  misc_feature 1..941: note = mRNA product Design f-3 comprising derived and/or modified sequence from HRSV(A2)__P04545.1__M2-1 (opt3)
  source 1..941: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11420 - RNA, 941 nt, synthetic construct
  misc_feature 1..941: note = mRNA product Design f-3 comprising derived and/or modified sequence from HRSV(A2)__P04545.1__M2-1 (opt4)
  source 1..941: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11421 - RNA, 941 nt, synthetic construct
  misc_feature 1..941: note = mRNA product Design f-3 comprising derived and/or modified sequence from HRSV(A2)__P04545.1__M2-1 (opt5)
  source 1..941: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11422 - RNA, 941 nt, synthetic construct
  misc_feature 1..941: note = mRNA product Design f-3 comprising derived and/or modified sequence from HRSV(A2)__P04545.1__M2-1 (opt6)
  source 1..941: mol_type = other RNA
gggagagtcccgcagtcggcgtccagcggctctgcttgttcgtgtgtgtgtcgttgcaggccttattcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11423 - RNA, 941 nt, synthetic construct
  misc_feature 1..941: note = mRNA product Design f-3 comprising derived and/or modified sequence from HRSV(A2)__P04545.1__M2-1 (opt11)
  source 1..941: mol_type = other RNA
gggagagtcccgcagtcggcgtccagcggctctgcttgttcgtgtgtgtgtcgttgcaggccttattcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11424 - RNA, 1157 nt, synthetic construct
  misc_feature 1..1157: note = mRNA product Design f-4 comprising derived and/or modified sequence from HRSV(A2)__P04545.1__M2-1 (wt)
  source 1..1157: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11425 - RNA, 1157 nt, synthetic construct
  misc_feature 1..1157: note = mRNA product Design f-4 comprising derived and/or modified sequence from HRSV(A2)__P04545.1__M2-1 (opt1)
  source 1..1157: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11426 - RNA, 1157 nt, synthetic construct
  misc_feature 1..1157: note = mRNA product Design f-4 comprising derived and/or modified sequence from HRSV(A2)__P04545.1__M2-1 (opt2)
  source 1..1157: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11427 - RNA, 1157 nt, synthetic construct
  misc_feature 1..1157: note = mRNA product Design f-4 comprising derived and/or modified sequence from HRSV(A2)__P04545.1__M2-1 (opt3)
  source 1..1157: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11428 - RNA, 1157 nt, synthetic construct
  misc_feature 1..1157: note = mRNA product Design f-4 comprising derived and/or modified sequence from HRSV(A2)__P04545.1__M2-1 (opt4)
  source 1..1157: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11429 - RNA, 1157 nt, synthetic construct
  misc_feature 1..1157: note = mRNA product Design f-4 comprising derived and/or modified sequence from HRSV(A2)__P04545.1__M2-1 (opt5)
  source 1..1157: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11430 - RNA, 1157 nt, synthetic construct
  misc_feature 1..1157: note = mRNA product Design f-4 comprising derived and/or modified sequence from HRSV(A2)__P04545.1__M2-1 (opt6)
  source 1..1157: mol_type = other RNA
gggagagtcccgcagtcggcgtccagcggctctgcttgttcgtgtgtgtgtcgttgcaggccttattcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11431 - RNA, 1157 nt, synthetic construct
  misc_feature 1..1157: note = mRNA product Design f-4 comprising derived and/or modified sequence from HRSV(A2)__P04545.1__M2-1 (opt11)
  source 1..1157: mol_type = other RNA
gggagagtcccgcagtcggcgtccagcggctctgcttgttcgtgtgtgtgtcgttgcaggccttattcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11432 - RNA, 933 nt, synthetic construct
  misc_feature 1..933: note = mRNA product Design f-5 comprising derived and/or modified sequence from HRSV(A2)__P04545.1__M2-1 (wt)
  source 1..933: mol_type = other RNA
gggagactttcccattctgtagcagaatttggtgttgcctgtggtcttggtcccgcggagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11433 - RNA, 933 nt, synthetic construct
  misc_feature 1..933: note = mRNA product Design f-5 comprising derived and/or modified sequence from HRSV(A2)__P04545.1__M2-1 (opt1)
  source 1..933: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11434 - RNA, 933 nt, synthetic construct
  misc_feature 1..933: note = mRNA product Design f-5 comprising derived and/or modified sequence from HRSV(A2)__P04545.1__M2-1 (opt2)
  source 1..933: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11435 - RNA, 933 nt, synthetic construct
  misc_feature 1..933: note = mRNA product Design f-5 comprising derived and/or modified sequence from HRSV(A2)__P04545.1__M2-1 (opt3)
  source 1..933: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11436 - RNA, 933 nt, synthetic construct
  misc_feature 1..933: note = mRNA product Design f-5 comprising derived and/or modified sequence from HRSV(A2)__P04545.1__M2-1 (opt4)
  source 1..933: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11437 - RNA, 933 nt, synthetic construct
  misc_feature 1..933: note = mRNA product Design f-5 comprising derived and/or modified sequence from HRSV(A2)__P04545.1__M2-1 (opt5)
  source 1..933: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11438 - RNA, 933 nt, synthetic construct
  misc_feature 1..933: note = mRNA product Design f-5 comprising derived and/or modified sequence from HRSV(A2)__P04545.1__M2-1 (opt6)
  source 1..933: mol_type = other RNA
gggagactttcccattctgtagcagaatttggtgttgcctgtggtcttggtcccgcggagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11439 - RNA, 933 nt, synthetic construct
  misc_feature 1..933: note = mRNA product Design f-5 comprising derived and/or modified sequence from HRSV(A2)__P04545.1__M2-1 (opt11)
  source 1..933: mol_type = other RNA
gggagactttcccattctgtagcagaatttggtgttgcctgtggtcttggtcccgcggagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11440 - RNA, 929 nt, synthetic construct
  misc_feature 1..929: note = mRNA product Design g-1 comprising derived and/or modified sequence from HRSV(A2)__P04545.1__M2-1 (wt)
  source 1..929: mol_type = other RNA
gggagactttcccattctgtagcagaatttggtgttgcctgtggtcttggtcccgcggagaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11441 - RNA, 929 nt, synthetic construct
  misc_feature 1..929: note = mRNA product Design g-1 comprising derived and/or modified sequence from HRSV(A2)__P04545.1__M2-1 (opt1)
  source 1..929: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11442 - RNA, 929 nt, synthetic construct
  misc_feature 1..929: note = mRNA product Design g-1 comprising derived and/or modified sequence from HRSV(A2)__P04545.1__M2-1 (opt2)
  source 1..929: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11443 - RNA, 929 nt, synthetic construct
  misc_feature 1..929: note = mRNA product Design g-1 comprising derived and/or modified sequence from HRSV(A2)__P04545.1__M2-1 (opt3)
  source 1..929: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11444 - RNA, 929 nt, synthetic construct
  misc_feature 1..929: note = mRNA product Design g-1 comprising derived and/or modified sequence from HRSV(A2)__P04545.1__M2-1 (opt4)
  source 1..929: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11445 - RNA, 929 nt, synthetic construct
  misc_feature 1..929: note = mRNA product Design g-1 comprising derived and/or modified sequence from HRSV(A2)__P04545.1__M2-1 (opt5)
  source 1..929: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11446 - RNA, 929 nt, synthetic construct
  misc_feature 1..929: note = mRNA product Design g-1 comprising derived and/or modified sequence from HRSV(A2)__P04545.1__M2-1 (opt6)
  source 1..929: mol_type = other RNA
gggagactttcccattctgtagcagaatttggtgttgcctgtggtcttggtcccgcggagaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11447 - RNA, 929 nt, synthetic construct
  misc_feature 1..929: note = mRNA product Design g-1 comprising derived and/or modified sequence from HRSV(A2)__P04545.1__M2-1 (opt11)
  source 1..929: mol_type = other RNA
gggagactttcccattctgtagcagaatttggtgttgcctgtggtcttggtcccgcggagaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11448 - RNA, 944 nt, synthetic construct
  misc_feature 1..944: note = mRNA product Design g-2 comprising derived and/or modified sequence from HRSV(A2)__P04545.1__M2-1 (wt)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11449 - RNA, 944 nt, synthetic construct
  misc_feature 1..944: note = mRNA product Design g-2 comprising derived and/or modified sequence from HRSV(A2)__P04545.1__M2-1 (opt1)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11450 - RNA, 944 nt, synthetic construct
  misc_feature 1..944: note = mRNA product Design g-2 comprising derived and/or modified sequence from HRSV(A2)__P04545.1__M2-1 (opt2)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11451 - RNA, 944 nt, synthetic construct
  misc_feature 1..944: note = mRNA product Design g-2 comprising derived and/or modified sequence from HRSV(A2)__P04545.1__M2-1 (opt3)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11452 - RNA, 944 nt, synthetic construct
  misc_feature 1..944: note = mRNA product Design g-2 comprising derived and/or modified sequence from HRSV(A2)__P04545.1__M2-1 (opt4)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11453 - RNA, 944 nt, synthetic construct
  misc_feature 1..944: note = mRNA product Design g-2 comprising derived and/or modified sequence from HRSV(A2)__P04545.1__M2-1 (opt5)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11454 - RNA, 944 nt, synthetic construct
  misc_feature 1..944: note = mRNA product Design g-2 comprising derived and/or modified sequence from HRSV(A2)__P04545.1__M2-1 (opt6)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11455 - RNA, 944 nt, synthetic construct
  misc_feature 1..944: note = mRNA product Design g-2 comprising derived and/or modified sequence from HRSV(A2)__P04545.1__M2-1 (opt11)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11456 - RNA, 1176 nt, synthetic construct
  misc_feature 1..1176: note = mRNA product Design g-3 comprising derived and/or modified sequence from HRSV(A2)__P04545.1__M2-1 (wt)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11457 - RNA, 1176 nt, synthetic construct
  misc_feature 1..1176: note = mRNA product Design g-3 comprising derived and/or modified sequence from HRSV(A2)__P04545.1__M2-1 (opt1)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11458 - RNA, 1176 nt, synthetic construct
  misc_feature 1..1176: note = mRNA product Design g-3 comprising derived and/or modified sequence from HRSV(A2)__P04545.1__M2-1 (opt2)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11459 - RNA, 1176 nt, synthetic construct
  misc_feature 1..1176: note = mRNA product Design g-3 comprising derived and/or modified sequence from HRSV(A2)__P04545.1__M2-1 (opt3)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11460 - RNA, 1176 nt, synthetic construct
  misc_feature 1..1176: note = mRNA product Design g-3 comprising derived and/or modified sequence from HRSV(A2)__P04545.1__M2-1 (opt4)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11461 - RNA, 1176 nt, synthetic construct
  misc_feature 1..1176: note = mRNA product Design g-3 comprising derived and/or modified sequence from HRSV(A2)__P04545.1__M2-1 (opt5)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11462 - RNA, 1176 nt, synthetic construct
  misc_feature 1..1176: note = mRNA product Design g-3 comprising derived and/or modified sequence from HRSV(A2)__P04545.1__M2-1 (opt6)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11463 - RNA, 1176 nt, synthetic construct
  misc_feature 1..1176: note = mRNA product Design g-3 comprising derived and/or modified sequence from HRSV(A2)__P04545.1__M2-1 (opt11)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11464 - RNA, 971 nt, synthetic construct
  misc_feature 1..971: note = mRNA product Design g-4 comprising derived and/or modified sequence from HRSV(A2)__P04545.1__M2-1 (wt)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11465 - RNA, 971 nt, synthetic construct
  misc_feature 1..971: note = mRNA product Design g-4 comprising derived and/or modified sequence from HRSV(A2)__P04545.1__M2-1 (opt1)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11466 - RNA, 971 nt, synthetic construct
  misc_feature 1..971: note = mRNA product Design g-4 comprising derived and/or modified sequence from HRSV(A2)__P04545.1__M2-1 (opt2)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11467 - RNA, 971 nt, synthetic construct
  misc_feature 1..971: note = mRNA product Design g-4 comprising derived and/or modified sequence from HRSV(A2)__P04545.1__M2-1 (opt3)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11468 - RNA, 971 nt, synthetic construct
  misc_feature 1..971: note = mRNA product Design g-4 comprising derived and/or modified sequence from HRSV(A2)__P04545.1__M2-1 (opt4)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11469 - RNA, 971 nt, synthetic construct
  misc_feature 1..971: note = mRNA product Design g-4 comprising derived and/or modified sequence from HRSV(A2)__P04545.1__M2-1 (opt5)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11470 - RNA, 971 nt, synthetic construct
  misc_feature 1..971: note = mRNA product Design g-4 comprising derived and/or modified sequence from HRSV(A2)__P04545.1__M2-1 (opt6)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11471 - RNA, 971 nt, synthetic construct
  misc_feature 1..971: note = mRNA product Design g-4 comprising derived and/or modified sequence from HRSV(A2)__P04545.1__M2-1 (opt11)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11472 - RNA, 947 nt, synthetic construct
  misc_feature 1..947: note = mRNA product Design g-5 comprising derived and/or modified sequence from HRSV(A2)__P04545.1__M2-1 (wt)
  source 1..947: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11473 - RNA, 947 nt, synthetic construct
  misc_feature 1..947: note = mRNA product Design g-5 comprising derived and/or modified sequence from HRSV(A2)__P04545.1__M2-1 (opt1)
  source 1..947: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11474 - RNA, 947 nt, synthetic construct
  misc_feature 1..947: note = mRNA product Design g-5 comprising derived and/or modified sequence from HRSV(A2)__P04545.1__M2-1 (opt2)
  source 1..947: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11475 - RNA, 947 nt, synthetic construct
  misc_feature 1..947: note = mRNA product Design g-5 comprising derived and/or modified sequence from HRSV(A2)__P04545.1__M2-1 (opt3)
  source 1..947: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11476 - RNA, 947 nt, synthetic construct
  misc_feature 1..947: note = mRNA product Design g-5 comprising derived and/or modified sequence from HRSV(A2)__P04545.1__M2-1 (opt4)
  source 1..947: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11477 - RNA, 947 nt, synthetic construct
  misc_feature 1..947: note = mRNA product Design g-5 comprising derived and/or modified sequence from HRSV(A2)__P04545.1__M2-1 (opt5)
  source 1..947: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11478 - RNA, 947 nt, synthetic construct
  misc_feature 1..947: note = mRNA product Design g-5 comprising derived and/or modified sequence from HRSV(A2)__P04545.1__M2-1 (opt6)
  source 1..947: mol_type = other RNA
gggagacccgtgacccggaagttgtacggctacgcgactttccctcccacaaaccctcgcgcccttcctttcctacttgggcccggcagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11479 - RNA, 947 nt, synthetic construct
  misc_feature 1..947: note = mRNA product Design g-5 comprising derived and/or modified sequence from HRSV(A2)__P04545.1__M2-1 (opt11)
  source 1..947: mol_type = other RNA
gggagacccgtgacccggaagttgtacggctacgcgactttccctcccacaaaccctcgcgcccttcctttcctacttgggcccggcagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11480 - RNA, 963 nt, synthetic construct
  misc_feature 1..963: note = mRNA product Design h-1 comprising derived and/or modified sequence from HRSV(A2)__P04545.1__M2-1 (wt)
  source 1..963: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11481 - RNA, 963 nt, synthetic construct
  misc_feature 1..963: note = mRNA product Design h-1 comprising derived and/or modified sequence from HRSV(A2)__P04545.1__M2-1 (opt1)
  source 1..963: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11482 - RNA, 963 nt, synthetic construct
  misc_feature 1..963: note = mRNA product Design h-1 comprising derived and/or modified sequence from HRSV(A2)__P04545.1__M2-1 (opt2)
  source 1..963: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11483 - RNA, 963 nt, synthetic construct
  misc_feature 1..963: note = mRNA product Design h-1 comprising derived and/or modified sequence from HRSV(A2)__P04545.1__M2-1 (opt3)
  source 1..963: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11484 - RNA, 963 nt, synthetic construct
  misc_feature 1..963: note = mRNA product Design h-1 comprising derived and/or modified sequence from HRSV(A2)__P04545.1__M2-1 (opt4)
  source 1..963: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11485 - RNA, 963 nt, synthetic construct
  misc_feature 1..963: note = mRNA product Design h-1 comprising derived and/or modified sequence from HRSV(A2)__P04545.1__M2-1 (opt5)
  source 1..963: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11486 - RNA, 963 nt, synthetic construct
  misc_feature 1..963: note = mRNA product Design h-1 comprising derived and/or modified sequence from HRSV(A2)__P04545.1__M2-1 (opt6)
  source 1..963: mol_type = other RNA
gggagacccgtgacccggaagttgtacggctacgcgactttccctcccacaaaccctcgcgcccttcctttcctacttgggcccggcagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11487 - RNA, 963 nt, synthetic construct
  misc_feature 1..963: note = mRNA product Design h-1 comprising derived and/or modified sequence from HRSV(A2)__P04545.1__M2-1 (opt11)
  source 1..963: mol_type = other RNA
gggagacccgtgacccggaagttgtacggctacgcgactttccctcccacaaaccctcgcgcccttcctttcctacttgggcccggcagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11488 - RNA, 1179 nt, synthetic construct
  misc_feature 1..1179: note = mRNA product Design h-2 comprising derived and/or modified sequence from HRSV(A2)__P04545.1__M2-1 (wt)
  source 1..1179: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11489 - RNA, 1179 nt, synthetic construct
  misc_feature 1..1179: note = mRNA product Design h-2 comprising derived and/or modified sequence from HRSV(A2)__P04545.1__M2-1 (opt1)
  source 1..1179: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11490 - RNA, 1179 nt, synthetic construct
  misc_feature 1..1179: note = mRNA product Design h-2 comprising derived and/or modified sequence from HRSV(A2)__P04545.1__M2-1 (opt2)
  source 1..1179: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11491 - RNA, 1179 nt, synthetic construct
  misc_feature 1..1179: note = mRNA product Design h-2 comprising derived and/or modified sequence from HRSV(A2)__P04545.1__M2-1 (opt3)
  source 1..1179: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11492 - RNA, 1179 nt, synthetic construct
  misc_feature 1..1179: note = mRNA product Design h-2 comprising derived and/or modified sequence from HRSV(A2)__P04545.1__M2-1 (opt4)
  source 1..1179: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11493 - RNA, 1179 nt, synthetic construct
  misc_feature 1..1179: note = mRNA product Design h-2 comprising derived and/or modified sequence from HRSV(A2)__P04545.1__M2-1 (opt5)
  source 1..1179: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11494 - RNA, 1179 nt, synthetic construct
  misc_feature 1..1179: note = mRNA product Design h-2 comprising derived and/or modified sequence from HRSV(A2)__P04545.1__M2-1 (opt6)
  source 1..1179: mol_type = other RNA
gggagacccgtgacccggaagttgtacggctacgcgactttccctcccacaaaccctcgcgcccttcctttcctacttgggcccggcagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11495 - RNA, 1179 nt, synthetic construct
  misc_feature 1..1179: note = mRNA product Design h-2 comprising derived and/or modified sequence from HRSV(A2)__P04545.1__M2-1 (opt11)
  source 1..1179: mol_type = other RNA
gggagacccgtgacccggaagttgtacggctacgcgactttccctcccacaaaccctcgcgcccttcctttcctacttgggcccggcagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11496 - RNA, 959 nt, synthetic construct
  misc_feature 1..959: note = mRNA product Design h-3 comprising derived and/or modified sequence from HRSV(A2)__P04545.1__M2-1 (wt)
  source 1..959: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11497 - RNA, 959 nt, synthetic construct
  misc_feature 1..959: note = mRNA product Design h-3 comprising derived and/or modified sequence from HRSV(A2)__P04545.1__M2-1 (opt1)
  source 1..959: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11498 - RNA, 959 nt, synthetic construct
  misc_feature 1..959: note = mRNA product Design h-3 comprising derived and/or modified sequence from HRSV(A2)__P04545.1__M2-1 (opt2)
  source 1..959: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11499 - RNA, 959 nt, synthetic construct
  misc_feature 1..959: note = mRNA product Design h-3 comprising derived and/or modified sequence from HRSV(A2)__P04545.1__M2-1 (opt3)
  source 1..959: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11500 - RNA, 959 nt, synthetic construct
  misc_feature 1..959: note = mRNA product Design h-3 comprising derived and/or modified sequence from HRSV(A2)__P04545.1__M2-1 (opt4)
  source 1..959: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11501 - RNA, 959 nt, synthetic construct
  misc_feature 1..959: note = mRNA product Design h-3 comprising derived and/or modified sequence from HRSV(A2)__P04545.1__M2-1 (opt5)
  source 1..959: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11502 - RNA, 959 nt, synthetic construct
  misc_feature 1..959: note = mRNA product Design h-3 comprising derived and/or modified sequence from HRSV(A2)__P04545.1__M2-1 (opt6)
  source 1..959: mol_type = other RNA
gggagacccgtgacccggaagttgtacggctacgcgactttccctcccacaaaccctcgcgcccttcctttcctacttgggcccggcagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11503 - RNA, 959 nt, synthetic construct
  misc_feature 1..959: note = mRNA product Design h-3 comprising derived and/or modified sequence from HRSV(A2)__P04545.1__M2-1 (opt11)
  source 1..959: mol_type = other RNA
gggagacccgtgacccggaagttgtacggctacgcgactttccctcccacaaaccctcgcgcccttcctttcctacttgggcccggcagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11504 - RNA, 1022 nt, synthetic construct
  misc_feature 1..1022: note = mRNA product Design h-4 comprising derived and/or modified sequence from HRSV(A2)__P04545.1__M2-1 (wt)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11505 - RNA, 1022 nt, synthetic construct
  misc_feature 1..1022: note = mRNA product Design h-4 comprising derived and/or modified sequence from HRSV(A2)__P04545.1__M2-1 (opt1)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11506 - RNA, 1022 nt, synthetic construct
  misc_feature 1..1022: note = mRNA product Design h-4 comprising derived and/or modified sequence from HRSV(A2)__P04545.1__M2-1 (opt2)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11507 - RNA, 1022 nt, synthetic construct
  misc_feature 1..1022: note = mRNA product Design h-4 comprising derived and/or modified sequence from HRSV(A2)__P04545.1__M2-1 (opt3)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11508 - RNA, 1022 nt, synthetic construct
  misc_feature 1..1022: note = mRNA product Design h-4 comprising derived and/or modified sequence from HRSV(A2)__P04545.1__M2-1 (opt4)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11509 - RNA, 1022 nt, synthetic construct
  misc_feature 1..1022: note = mRNA product Design h-4 comprising derived and/or modified sequence from HRSV(A2)__P04545.1__M2-1 (opt5)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11510 - RNA, 1022 nt, synthetic construct
  misc_feature 1..1022: note = mRNA product Design h-4 comprising derived and/or modified sequence from HRSV(A2)__P04545.1__M2-1 (opt6)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11511 - RNA, 1022 nt, synthetic construct
  misc_feature 1..1022: note = mRNA product Design h-4 comprising derived and/or modified sequence from HRSV(A2)__P04545.1__M2-1 (opt11)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11512 - RNA, 1038 nt, synthetic construct
  misc_feature 1..1038: note = mRNA product Design h-5 comprising derived and/or modified sequence from HRSV(A2)__P04545.1__M2-1 (wt)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11513 - RNA, 1038 nt, synthetic construct
  misc_feature 1..1038: note = mRNA product Design h-5 comprising derived and/or modified sequence from HRSV(A2)__P04545.1__M2-1 (opt1)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11514 - RNA, 1038 nt, synthetic construct
  misc_feature 1..1038: note = mRNA product Design h-5 comprising derived and/or modified sequence from HRSV(A2)__P04545.1__M2-1 (opt2)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11515 - RNA, 1038 nt, synthetic construct
  misc_feature 1..1038: note = mRNA product Design h-5 comprising derived and/or modified sequence from HRSV(A2)__P04545.1__M2-1 (opt3)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11516 - RNA, 1038 nt, synthetic construct
  misc_feature 1..1038: note = mRNA product Design h-5 comprising derived and/or modified sequence from HRSV(A2)__P04545.1__M2-1 (opt4)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11517 - RNA, 1038 nt, synthetic construct
  misc_feature 1..1038: note = mRNA product Design h-5 comprising derived and/or modified sequence from HRSV(A2)__P04545.1__M2-1 (opt5)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11518 - RNA, 1038 nt, synthetic construct
  misc_feature 1..1038: note = mRNA product Design h-5 comprising derived and/or modified sequence from HRSV(A2)__P04545.1__M2-1 (opt6)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11519 - RNA, 1038 nt, synthetic construct
  misc_feature 1..1038: note = mRNA product Design h-5 comprising derived and/or modified sequence from HRSV(A2)__P04545.1__M2-1 (opt11)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11520 - RNA, 971 nt, synthetic construct
  misc_feature 1..971: note = mRNA product Design i-1 comprising derived and/or modified sequence from HRSV(A2)__P04545.1__M2-1 (wt)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11521 - RNA, 971 nt, synthetic construct
  misc_feature 1..971: note = mRNA product Design i-1 comprising derived and/or modified sequence from HRSV(A2)__P04545.1__M2-1 (opt1)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11522 - RNA, 971 nt, synthetic construct
  misc_feature 1..971: note = mRNA product Design i-1 comprising derived and/or modified sequence from HRSV(A2)__P04545.1__M2-1 (opt2)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11523 - RNA, 971 nt, synthetic construct
  misc_feature 1..971: note = mRNA product Design i-1 comprising derived and/or modified sequence from HRSV(A2)__P04545.1__M2-1 (opt3)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11524 - RNA, 971 nt, synthetic construct
  misc_feature 1..971: note = mRNA product Design i-1 comprising derived and/or modified sequence from HRSV(A2)__P04545.1__M2-1 (opt4)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11525 - RNA, 971 nt, synthetic construct
  misc_feature 1..971: note = mRNA product Design i-1 comprising derived and/or modified sequence from HRSV(A2)__P04545.1__M2-1 (opt5)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11526 - RNA, 971 nt, synthetic construct
  misc_feature 1..971: note = mRNA product Design i-1 comprising derived and/or modified sequence from HRSV(A2)__P04545.1__M2-1 (opt6)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11527 - RNA, 971 nt, synthetic construct
  misc_feature 1..971: note = mRNA product Design i-1 comprising derived and/or modified sequence from HRSV(A2)__P04545.1__M2-1 (opt11)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11528 - RNA, 971 nt, synthetic construct
  misc_feature 1..971: note = mRNA product Design i-2 comprising derived and/or modified sequence from HRSV(A2)__P04545.1__M2-1 (wt)
  source 1..971: mol_type = other RNA
gggagaggcgctgcctacggaggtggcagccatctccttctcggcatcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11529 - RNA, 971 nt, synthetic construct
  misc_feature 1..971: note = mRNA product Design i-2 comprising derived and/or modified sequence from HRSV(A2)__P04545.1__M2-1 (opt1)
  source 1..971: mol_type = other RNA
gggagaggcgctgcctacggaggtggcagccatctccttctcggcatcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11530 - RNA, 971 nt, synthetic construct
  misc_feature 1..971: note = mRNA product Design i-2 comprising derived and/or modified sequence from HRSV(A2)__P04545.1__M2-1 (opt2)
  source 1..971: mol_type = other RNA
gggagaggcgctgcctacggaggtggcagccatctccttctcggcatcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11531 - RNA, 971 nt, synthetic construct
  misc_feature 1..971: note = mRNA product Design i-2 comprising derived and/or modified sequence from HRSV(A2)__P04545.1__M2-1 (opt3)
  source 1..971: mol_type = other RNA
gggagaggcgctgcctacggaggtggcagccatctccttctcggcatcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11532 - RNA, 971 nt, synthetic construct
  misc_feature 1..971: note = mRNA product Design i-2 comprising derived and/or modified sequence from HRSV(A2)__P04545.1__M2-1 (opt4)
  source 1..971: mol_type = other RNA
gggagaggcgctgcctacggaggtggcagccatctccttctcggcatcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11533 - RNA, 971 nt, synthetic construct
  misc_feature 1..971: note = mRNA product Design i-2 comprising derived and/or modified sequence from HRSV(A2)__P04545.1__M2-1 (opt5)
  source 1..971: mol_type = other RNA
gggagaggcgctgcctacggaggtggcagccatctccttctcggcatcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11534 - RNA, 971 nt, synthetic construct
  misc_feature 1..971: note = mRNA product Design i-2 comprising derived and/or modified sequence from HRSV(A2)__P04545.1__M2-1 (opt6)
  source 1..971: mol_type = other RNA
gggagaggcgctgcctacggaggtggcagccatctccttctcggcatcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11535 - RNA, 971 nt, synthetic construct
  misc_feature 1..971: note = mRNA product Design i-2 comprising derived and/or modified sequence from HRSV(A2)__P04545.1__M2-1 (opt11)
  source 1..971: mol_type = other RNA
gggagaggcgctgcctacggaggtggcagccatctccttctcggcatcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11536 - RNA, 967 nt, synthetic construct
  misc_feature 1..967: note = mRNA product Design i-2 comprising derived and/or modified sequence from HRSV(A2)__P04545.1__M2-1 (wt)
  source 1..967: mol_type = other RNA
ggggcgctgcctacggaggtggcagccatctccttctcggcatcaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11537 - RNA, 967 nt, synthetic construct
  misc_feature 1..967: note = mRNA product Design i-2 comprising derived and/or modified sequence from HRSV(A2)__P04545.1__M2-1 (opt1)
  source 1..967: mol_type = other RNA
ggggcgctgcctacggaggtggcagccatctccttctcggcatcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11538 - RNA, 967 nt, synthetic construct
  misc_feature 1..967: note = mRNA product Design i-2 comprising derived and/or modified sequence from HRSV(A2)__P04545.1__M2-1 (opt2)
  source 1..967: mol_type = other RNA
ggggcgctgcctacggaggtggcagccatctccttctcggcatcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11539 - RNA, 967 nt, synthetic construct
  misc_feature 1..967: note = mRNA product Design i-2 comprising derived and/or modified sequence from HRSV(A2)__P04545.1__M2-1 (opt3)
  source 1..967: mol_type = other RNA
ggggcgctgcctacggaggtggcagccatctccttctcggcatcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11540 - RNA, 967 nt, synthetic construct
  misc_feature 1..967: note = mRNA product Design i-2 comprising derived and/or modified sequence from HRSV(A2)__P04545.1__M2-1 (opt4)
  source 1..967: mol_type = other RNA
ggggcgctgcctacggaggtggcagccatctccttctcggcatcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11541 - RNA, 967 nt, synthetic construct
  misc_feature 1..967: note = mRNA product Design i-2 comprising derived and/or modified sequence from HRSV(A2)__P04545.1__M2-1 (opt5)
  source 1..967: mol_type = other RNA
ggggcgctgcctacggaggtggcagccatctccttctcggcatcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11542 - RNA, 967 nt, synthetic construct
  misc_feature 1..967: note = mRNA product Design i-2 comprising derived and/or modified sequence from HRSV(A2)__P04545.1__M2-1 (opt6)
  source 1..967: mol_type = other RNA
ggggcgctgcctacggaggtggcagccatctccttctcggcatcaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11543 - RNA, 967 nt, synthetic construct
  misc_feature 1..967: note = mRNA product Design i-2 comprising derived and/or modified sequence from HRSV(A2)__P04545.1__M2-1 (opt11)
  source 1..967: mol_type = other RNA
ggggcgctgcctacggaggtggcagccatctccttctcggcatcaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11544 - RNA, 802 nt, synthetic construct
  misc_feature 1..802: note = mRNA product Design i-3 comprising derived and/or modified sequence from HRSV(A2)__P04545.1__M2-1 (wt)
  source 1..802: mol_type = other RNA
gggagaaagcttaccatgtcacgaaggaatccttgcaaatttgaaattcgaggtcattgcttaaatggtaagaggtgtcattttagtcataattattttgaatggccaccccatgcactgcttgtaagacaaaactttatgttaaacagaatacttaagtctatggataaaagtatagataccttatcagaaataagtggagctgcagagttggacagaacagaagagtatgctcttggtgtagttggagtgctagagagttatataggatcaataaacaatataactaaacaatcagcatgtgttgccatgagcaaactcctcactgaactcaatagtgatgatatcaaaaagctgagggacaatgaagagctaaattcacccaagataagagtgtacaatactgtcatatcatatattgaaagcaacaggaaaaacaataaacaaactatccatctgttaaaaagattgccagcagacgtattgaagaaaaccatcaaaaacacattggatatccataagagcataaccatcaacaacccaaaagaatcaactgttagtgatacaaatgaccatgccaaaaataatgatactacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11545 - RNA, 802 nt, synthetic construct
  misc_feature 1..802: note = mRNA product Design i-3 comprising derived and/or modified sequence from HRSV(A2)__P04545.1__M2-1 (opt1) R7598
  source 1..802: mol_type = other RNA
gggagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11546 - RNA, 802 nt, synthetic construct
  misc_feature 1..802: note = mRNA product Design i-3 comprising derived and/or modified sequence from HRSV(A2)__P04545.1__M2-1 (opt2)
  source 1..802: mol_type = other RNA
gggagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagctcaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtctccgacaccaacgaccacgccaagaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11547 - RNA, 802 nt, synthetic construct
  misc_feature 1..802: note = mRNA product Design i-3 comprising derived and/or modified sequence from HRSV(A2)__P04545.1__M2-1 (opt3)
  source 1..802: mol_type = other RNA
gggagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaagagttaaatagtccgaaaatacgggtgtataacaccgtcatctcctacattgaatctaatcgcaagaacaataaacagacaatccatctgctgaagagactccccgccgacgtgctcaaaaagactattaagaacaccctggatatccacaaaagcataacaattaataaccctaaggagtccaccgtttcagacactaacgatcacgccaaaaataacgacacaacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11548 - RNA, 802 nt, synthetic construct
  misc_feature 1..802: note = mRNA product Design i-3 comprising derived and/or modified sequence from HRSV(A2)__P04545.1__M2-1 (opt4)
  source 1..802: mol_type = other RNA
gggagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagctgaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgagcgacaccaacgaccacgccaagaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11549 - RNA, 802 nt, synthetic construct
  misc_feature 1..802: note = mRNA product Design i-3 comprising derived and/or modified sequence from HRSV(A2)__P04545.1__M2-1 (opt5)
  source 1..802: mol_type = other RNA
gggagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaactgaatagccccaaaattcgcgtctataacacagtgatctcttacattgaatccaatagaaagaacaataaacagaccatccaccttctgaagcggctccctgccgacgttctgaaaaagacaattaagaacacccttgatatccataaaagcattacaatcaataaccccaaggagtctaccgtgtccgacacgaacgatcacgctaaaaataacgacaccacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11550 - RNA, 802 nt, synthetic construct
  misc_feature 1..802: note = mRNA product Design i-3 comprising derived and/or modified sequence from HRSV(A2)__P04545.1__M2-1 (opt6)
  source 1..802: mol_type = other RNA
gggagaaagcttaccatgtcaagaagaaacccatgcaaattcgaaataagaggacactgcctaaacggaaaaagatgccacttctcacacaactacttcgaatggccaccacacgcactacttgtaagacaaaacttcatgctaaacagaatactaaaatcaatggacaaatcaatagacacattatcagaaatatcaggagcagcagaactcgacagaacagaagaatacgcactaggagtagtaggagtactagaatcatacataggatcaataaacaacataacaaaacaatcagcatgcgtagccatgtccaaactactaacagaactaaactccgacgacataaaaaaactaagagacaacgaagaactaaactcaccaaaaataagagtatacaacacagtaatatcatacatagaatcaaacagaaaaaacaataaacaaacaatacacctactaaaaagactcccagcagacgtactaaaaaaaacaataaaaaacacactagacatccacaaatcaataacaataaacaacccaaaagaatcaacagtctcagacaccaacgaccacgcaaaaaacaacgacacaacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11551 - RNA, 802 nt, synthetic construct
  misc_feature 1..802: note = mRNA product Design i-3 comprising derived and/or modified sequence from HRSV(A2)__P04545.1__M2-1 (opt11)
  source 1..802: mol_type = other RNA
gggagaaagcttaccatgtcacgacgcaacccctgcaaattcgaaatccgcggccactgcctaaacggcaaacgctgccacttctcccacaactacttcgaatggcccccccacgccctccttgtccgccaaaacttcatgctcaaccgcatcctcaaatccatggacaaaagcatcgacaccctctccgaaatctccggcgcagccgaactcgaccgcaccgaagaatacgccctcggcgtcgtaggcgtcctcgaatcctacatcggctcaatcaacaacatcaccaaacaatccgcctgcgtcgccatgtccaaactcctcaccgaactcaactccgacgacatcaaaaaactccgcgacaacgaagaactcaactcccccaaaatccgagtctacaacaccgtaatctcctacatcgaatccaaccgcaaaaacaacaaacaaaccatccacctactaaaacgactccccgccgacgtcctcaaaaaaacaatcaaaaacaccctcgacatccacaaatccatcaccatcaacaaccccaaagaatcaaccgtctccgacaccaacgaccacgccaaaaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11552 - protein, 194 aa, synthetic construct
  REGION 1..194: note = derived and/or modified protein sequence (wt) from HRSV(Memphis-37)__AIY60641.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11553 - protein, 195 aa, synthetic construct
  REGION 1..195: note = derived and/or modified protein sequence (wt) from HRSV__O42050.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSIIISNPKESTVNDQNDQTKNNDITG

SEQ ID NO: 11554 - protein, 194 aa, synthetic construct
  REGION 1..194: note = derived and/or modified protein sequence (wt) from HRSV__AAR14267.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVNDQNDQTKNNDIT

SEQ ID NO: 11555 - protein, 194 aa, synthetic construct
  REGION 1..194: note = derived and/or modified protein sequence (wt) from HRSV__AAX23995.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKELTVSDTNDHAKNNDTT

SEQ ID NO: 11556 - protein, 194 aa, synthetic construct
  REGION 1..194: note = derived and/or modified protein sequence (wt) from HRSV__ACY68436.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVSDTNDHAKNNDTT

SEQ ID NO: 11557 - protein, 194 aa, synthetic construct
  REGION 1..194: note = derived and/or modified protein sequence (wt) from HRSV__AEO45831.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNGDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11558 - protein, 194 aa, synthetic construct
  REGION 1..194: note = derived and/or modified protein sequence (wt) from HRSV__AEO45900.1__M2-1
MSRRNPCKFEIRGHCLNGKRCHFSHNYFEWPPHALLVRQNFMLNRILKSMDKSIDTSSEISGAAELDRTEEYALGVVGVLESYIGSINNITKQSACVAMSKLLTELNSDDIKKLRDNEELNSPKVRVYNTVISYIESNRKNNKQTIHLLKRLPADVLKKTIKNTLDIHKSITINNPKESTVNDTNDHAKNNDTT

SEQ ID NO: 11559 - protein, 194 aa, synthetic construct
  REGION 1..194: note = derived and/or modified protein sequence (wt) from HRSV__AEO45910.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDTEEPNSPKIRVYNTVISYIESNRKNNKQTIHLLKRLPADVLKKTMKNTLDIHKSITINNPKESTVSDTNYHAKNNDTT

SEQ ID NO: 11560 - protein, 194 aa, synthetic construct
  REGION 1..194: note = derived and/or modified protein sequence (wt) from HRSV__AEO45920.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDTEEPNSPKIRVYNTVISYIESNRKNNKQTIHLLKRLPADVLKKTIKNTLDIHKSITINNPKESTVSDTDYHAKNNDTT

SEQ ID NO: 11561 - protein, 194 aa, synthetic construct
  REGION 1..194: note = derived and/or modified protein sequence (wt) from HRSV__AEO45930.1__M2-1
MSRRNPCKFEIRGHCLNGRRCHFSHNYFEWPPHALLVRQNFMLNRILKSMDRSIDTLSEISGAAELDRTEEYALGVVGVLESYIGSLNNITKQSACVAMSKLLTELNSDDIKKLRDSEEPNSPKVRVYNTVTSYIESNRKNNKQTIHLLKRLPADVLKKTIKNTLDIHKSITINNPKESTVSDTNDHAKNNDTT

SEQ ID NO: 11562 - protein, 194 aa, synthetic construct
  REGION 1..194: note = derived and/or modified protein sequence (wt) from HRSV__AEO45940.1__M2-1
MSRRNPCKFEIRGHCLNGRRCHFSHNYFEWPPHALLVRQNFMLNRILKSMDRSIDTLSEISGAAELDRTEEYALGVVGVLESYIGSLNNITKQSACVAMSKLLTELNSDDIKKLRDSEEPNSPKVRVYNTVTSYIESNRKNNKQTIHLLKRVPADVLKKTIKNTLDIHKSITINNPKESTVSDTNDHAKNNDTT

SEQ ID NO: 11563 - protein, 194 aa, synthetic construct
  REGION 1..194: note = derived and/or modified protein sequence (wt) from HRSV__AEQ63313.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11564 - protein, 194 aa, synthetic construct
  REGION 1..194: note = derived and/or modified protein sequence (wt) from HRSV__AEQ63401.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDHEEPNSPKVRVYNTVISYIESNRKNNKQTIHLLKRLPADVLKKTIKNTLDIHKSITINNPKESTVSDTNDHAKNNDTT

SEQ ID NO: 11565 - protein, 194 aa, synthetic construct
  REGION 1..194: note = derived and/or modified protein sequence (wt) from HRSV__AEQ63423.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKRLRDNEEPNSPKVRVYNTVISYIESNRKNNKQTIHLLKRLPADVLKKTIKNTLDIHKSITINNPKESTVSDTNDHAKNNDTT

SEQ ID NO: 11566 - protein, 194 aa, synthetic construct
  REGION 1..194: note = derived and/or modified protein sequence (wt) from HRSV__AEQ63434.1__M2-1
MSRRNPCKFEIRGHCLNGKRCHFSHNYFEWPPHALLVRQNFMLNRILKSMDRSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11567 - protein, 194 aa, synthetic construct
  REGION 1..194: note = derived and/or modified protein sequence (wt) from HRSV__AEQ63488.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDTEEPNSPKIRVYNTVISYIESNRKNNKQTIHLLKRLPADVLKKTIKNTLDIHKSITINNPKESTASDTDDHAKNNDTT

SEQ ID NO: 11568 - protein, 194 aa, synthetic construct
  REGION 1..194: note = derived and/or modified protein sequence (wt) from HRSV__AEQ63521.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDTEEPNSPKIRVYNTVISYIESNRKNNKQTIHLLKRLPADVLKKTIKNTLDIHKSITINNPKESTVSDTDDHAKNNDTT

SEQ ID NO: 11569 - protein, 194 aa, synthetic construct
  REGION 1..194: note = derived and/or modified protein sequence (wt) from HRSV__AEQ63587.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTASDQNDQTKNNDIT

SEQ ID NO: 11570 - protein, 194 aa, synthetic construct
  REGION 1..194: note = derived and/or modified protein sequence (wt) from HRSV__AEQ63598.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTISDQNDQTKNNDIT

SEQ ID NO: 11571 - protein, 194 aa, synthetic construct
  REGION 1..194: note = derived and/or modified protein sequence (wt) from HRSV__AEQ63609.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVNDQNDQTKNNDIT

SEQ ID NO: 11572 - protein, 194 aa, synthetic construct
  REGION 1..194: note = derived and/or modified protein sequence (wt) from HRSV__AEQ63620.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLQRLPADVLKKTIKNTLDIHKSITISNPKESTISDQNDQTKNNDIT

SEQ ID NO: 11573 - protein, 194 aa, synthetic construct
  REGION 1..194: note = derived and/or modified protein sequence (wt) from HRSV__AEQ63642.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESIASDQNDQTKNNDIT

SEQ ID NO: 11574 - protein, 194 aa, synthetic construct
  REGION 1..194: note = derived and/or modified protein sequence (wt) from HRSV__AEQ63653.1__M2-1
MSRRNPCKFEIRGHCLNGRRCHYSHNYFEWPPHALLVRQNFMLNKILKSMDKSIDTLSEISGAAELDRTEEYALGIVGVLESYIGSITNITKQSACVAMSKLLIEISSDDIKKLRDNEEPNSPKIRVYNTVISYIESNRKNNKQTIHLLKRLPADVLKKTIKNTLDIHKSITISNPKESTISDQNDQTKNNDIT

SEQ ID NO: 11575 - protein, 194 aa, synthetic construct
  REGION 1..194: note = derived and/or modified protein sequence (wt) from HRSV__AEQ63664.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11576 - protein, 194 aa, synthetic construct
  REGION 1..194: note = derived and/or modified protein sequence (wt) from HRSV__AFI25252.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVSDQNDQTKNNDIT

SEQ ID NO: 11577 - protein, 194 aa, synthetic construct
  REGION 1..194: note = derived and/or modified protein sequence (wt) from HRSV__AFI25263.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESAVSDQNDQTKNNDIT

SEQ ID NO: 11578 - protein, 194 aa, synthetic construct
  REGION 1..194: note = derived and/or modified protein sequence (wt) from HRSV__AFM55212.1__M2-1
MSRRNPCKFEIRGHCLNGKRCHFSHNYFEWPPHALLVRQNFMLNRILKSMDRSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVGDTNDHAKNNDTT

SEQ ID NO: 11579 - protein, 194 aa, synthetic construct
  REGION 1..194: note = derived and/or modified protein sequence (wt) from HRSV__AFM55223.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNNHAKNNDTT

SEQ ID NO: 11580 - protein, 194 aa, synthetic construct
  REGION 1..194: note = derived and/or modified protein sequence (wt) from HRSV__AFM55234.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLKDNEEPNSPKIRVYNTVISYIESNRKNNKQTIHLLKRLPADVLKKTIKNTLDIHKSITINNPKESTVNDTNDHAKNNDTT

SEQ ID NO: 11581 - protein, 194 aa, synthetic construct
  REGION 1..194: note = derived and/or modified protein sequence (wt) from HRSV__AFM55256.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKNITINNPKESTVNDTNDHAKNNDTT

SEQ ID NO: 11582 - protein, 194 aa, synthetic construct
  REGION 1..194: note = derived and/or modified protein sequence (wt) from HRSV__AFM55333.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVTSYIESNRKNNKQTIHLLKRLPADVLKKTIKNTLDIHKSITINNPKESTVSDTNDHAKNNDTT

SEQ ID NO: 11583 - protein, 194 aa, synthetic construct
  REGION 1..194: note = derived and/or modified protein sequence (wt) from HRSV__AFM55355.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLIELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11584 - protein, 194 aa, synthetic construct
  REGION 1..194: note = derived and/or modified protein sequence (wt) from HRSV__AFM55410.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTTDHAKNNDTT

SEQ ID NO: 11585 - protein, 194 aa, synthetic construct
  REGION 1..194: note = derived and/or modified protein sequence (wt) from HRSV__AFM55421.1__M2-1
MSRRNPCKFEIRGHCLNGKRCHFSHNYFEWPPHALLVRQNFMLNRILKSMDRSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNNHAKNNDTT

SEQ ID NO: 11586 - protein, 194 aa, synthetic construct
  REGION 1..194: note = derived and/or modified protein sequence (wt) from HRSV__AGN28452.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSSKIRVYNTVISYIESNRKNSKQTIHLLKRLPADVLKKTIKNTLDIHKSITISNPKESTASDQNDQTKNNDIT

SEQ ID NO: 11587 - protein, 194 aa, synthetic construct
  REGION 1..194: note = derived and/or modified protein sequence (wt) from HRSV__AGN28562.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEISSDDIKKLRDNEEPNSPKIRVYNTVISYIESNRKNNKQTIHLLKRLPADVLKKTIKNTLDIHKSITISNPKESTISDQNDQTKNNDIT

SEQ ID NO: 11588 - protein, 194 aa, synthetic construct
  REGION 1..194: note = derived and/or modified protein sequence (wt) from HRSV__AGN28749.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTENNDIT

SEQ ID NO: 11589 - protein, 194 aa, synthetic construct
  REGION 1..194: note = derived and/or modified protein sequence (wt) from HRSV__AGT28737.1__M2-1
MSRRNPCKFEIRGHCLNGKRCHFSHNYFEWPPHALLVRQNFMLNKILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVSDTNDHAKNNDTT

SEQ ID NO: 11590 - protein, 194 aa, synthetic construct
  REGION 1..194: note = derived and/or modified protein sequence (wt) from HRSV__AGT75380.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDSRESITINNPKESTVNDTNDHAKNNDTT

SEQ ID NO: 11591 - protein, 194 aa, synthetic construct
  REGION 1..194: note = derived and/or modified protein sequence (wt) from HRSV__AHA83684.1__M2-1
MSRKNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11592 - protein, 194 aa, synthetic construct
  REGION 1..194: note = derived and/or modified protein sequence (wt) from HRSV__AHA83706.1__M2-1
MSRRNPCKFEIRGHCLNGRRCHYSHNYFEWPPHALLVRQNFMLNKILKSMDKSIDTLSEISGAAELDRTEEYALGIVGVLESYIGSVNNITKQSACVAMSKLLIEINSDDIKKLRDNEEPNSPKIRVYNTVISYIESNRKNSKQTIHLLKRLPADVLKKTIKNTLDIHKSITISNPKESTVNDQNDQTKNNDIT

SEQ ID NO: 11593 - protein, 194 aa, synthetic construct
  REGION 1..194: note = derived and/or modified protein sequence (wt) from HRSV__AHA83750.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVNDQDDQTKNNDIT

SEQ ID NO: 11594 - protein, 194 aa, synthetic construct
  REGION 1..194: note = derived and/or modified protein sequence (wt) from HRSV__AHA83761.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTKDHAKNNDTT

SEQ ID NO: 11595 - protein, 194 aa, synthetic construct
  REGION 1..194: note = derived and/or modified protein sequence (wt) from HRSV__AHA83783.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESIVNDTTDHAKNNDTT

SEQ ID NO: 11596 - protein, 194 aa, synthetic construct
  REGION 1..194: note = derived and/or modified protein sequence (wt) from HRSV__AHA83991.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEISSDDIKKLRDNEEPNSPKIRVYNTVISYIESNRKNNKQTIHLLKRLPADVLKKTIKNTLDIHKSITISNPKEPTISDQNDQTKNNDIT

SEQ ID NO: 11597 - protein, 194 aa, synthetic construct
  REGION 1..194: note = derived and/or modified protein sequence (wt) from HRSV__AHA84046.1__M2-1
MSRKNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDHEEPNSPKVRVYNTVISYIESNRKNNKQTIHLLKRLPADVLKKTIKNTLDIHKSITINNPKESTVSDTNDHAKNNDTT

SEQ ID NO: 11598 - protein, 194 aa, synthetic construct
  REGION 1..194: note = derived and/or modified protein sequence (wt) from HRSV__AHA84079.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTTSDQNDQTKNNDIT

SEQ ID NO: 11599 - protein, 194 aa, synthetic construct
  REGION 1..194: note = derived and/or modified protein sequence (wt) from HRSV__AHE57805.1__M2-1
MSRRNPCKFEIRGHCLNGKRCHFSHNYFEWSPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11600 - protein, 194 aa, synthetic construct
  REGION 1..194: note = derived and/or modified protein sequence (wt) from HRSV__AHV80770.1__M2-1
MSRRNPCKFEIRGHCLNGKRCHFSHNYFEWPPHALLVRQNFMLNRILKSMDRSIDTLSEISGAAELDRTEEYALGVVGVLESYIGSLNNITKQSACVAMSKLLTELSSDDIKKLRDSEEPNSPKVRVYNTVTSYIESNRKNNKQTIHLLKRLPADVLKKTIKNTLDIHKSITINNPKESTVSDTNDHAKNNDTT

SEQ ID NO: 11601 - protein, 194 aa, synthetic construct
  REGION 1..194: note = derived and/or modified protein sequence (wt) from HRSV__AHV80781.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVTSYIESNRKNSKQTIHLLKRLPADVLKKTIKNTLDIHKSITISNPKESTVSDQNDQTKNNDIT

SEQ ID NO: 11602 - protein, 194 aa, synthetic construct
  REGION 1..194: note = derived and/or modified protein sequence (wt) from HRSV__AHV80804.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEISSDDIKKLRDNEEPNSPKIRVYNTVISYIESNRKNNKQTIHLLKRLPADVLKKTIKNTLDIHKSITISNPKESTISDQNDQTKNDDIT

SEQ ID NO: 11603 - protein, 194 aa, synthetic construct
  REGION 1..194: note = derived and/or modified protein sequence (wt) from HRSV__AHV80815.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDHEEPNSPKVRVYNTVISYIESNRKNNKQTIHLLKRLPADVLKKTIKNTLDIHKSITINNPRESTVSDTNDHAKNNDTT

SEQ ID NO: 11604 - protein, 194 aa, synthetic construct
  REGION 1..194: note = derived and/or modified protein sequence (wt) from HRSV__AHV80848.1__M2-1
MSRRNPCKFEIRGHCLNGKRCHFSHNYFEWPPHALLVRQNFMLNRILKSMDRSIDTLSEISGAAELDRTEEYALGVVGVLESYIGSLNNITKQSACVAMSKLLTELSSDDIKKLRDSEEPNSPKIRVYNTVTSYIESNRKNNKQTIHLLKRLPADVLKKTIKNTLDIHKSITINNPKESTVSDTNDHAKNNDTT

SEQ ID NO: 11605 - protein, 194 aa, synthetic construct
  REGION 1..194: note = derived and/or modified protein sequence (wt) from HRSV__AHV80925.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLFIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11606 - protein, 194 aa, synthetic construct
  REGION 1..194: note = derived and/or modified protein sequence (wt) from HRSV__AHV81024.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDHEEPNSPKVRVYNTVISYIESNRKNNKQTIHLLKRLPADVLRKTIKNTLDIHKSITINNPKESTVSDTNDHAKNNDTT

SEQ ID NO: 11607 - protein, 194 aa, synthetic construct
  REGION 1..194: note = derived and/or modified protein sequence (wt) from HRSV__AHV81090.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEELNSPKIRVYNTVISYIESNRKNSKQTIHLLKRLPADVLKKTIKNTLDIHKSITISNPKESTISDQNDQTKNNDIT

SEQ ID NO: 11608 - protein, 194 aa, synthetic construct
  REGION 1..194: note = derived and/or modified protein sequence (wt) from HRSV__AHV81320.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEELNSPKIRVYNTVISYIESNRKNSKQTIHLLKRLPADVLKKTIKNTLDIHKSITISNPKESTVSDQNDQTKNNDIT

SEQ ID NO: 11609 - protein, 194 aa, synthetic construct
  REGION 1..194: note = derived and/or modified protein sequence (wt) from HRSV__AHV81353.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDSEEPNSPKIRVYNTVISYIESNRKNSKQTIHLLKRLPADVLKKTIKNTLDIHKSITISNPKESTVSDQNDQTKNNDIT

SEQ ID NO: 11610 - protein, 194 aa, synthetic construct
  REGION 1..194: note = derived and/or modified protein sequence (wt) from HRSV__AHV81386.1__M2-1
MSRRNPCKFEIRGHCLNGKRCHFSHNYFEWPPHALLVRQNFMLNRILKSMDKSIDTLSEISGAAELDRTEEYALGIVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11611 - protein, 194 aa, synthetic construct
  REGION 1..194: note = derived and/or modified protein sequence (wt) from HRSV__AHV81485.1__M2-1
MSRRNPCKFEIRGHCLNGKRCHFSHNYFEWPPHALLVRQNFMLNRILKSMDRSIDTLSEISGAAELDRTEEYALGVVGVLESYIGSLNNITKQSACVAMSKLLTELSSDDIKKLRDSEEPNSPKVKVYNTVTSYIESNRKNNKQTIHLLKRLPADVLKKTIKNTLDIHKSITINNPKESTVSDTNDHAKNNDTT

SEQ ID NO: 11612 - protein, 194 aa, synthetic construct
  REGION 1..194: note = derived and/or modified protein sequence (wt) from HRSV__AHV81650.1__M2-1
MSRRNPCKFEIRGHCLNGRRCHYSHNYLEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTISDQNDQTKNNDIT

SEQ ID NO: 11613 - protein, 194 aa, synthetic construct
  REGION 1..194: note = derived and/or modified protein sequence (wt) from HRSV__AHV81815.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPAEVLKKTIKNTLDIHKSITINNPKESTVSDTNDHAKNNDTT

SEQ ID NO: 11614 - protein, 194 aa, synthetic construct
  REGION 1..194: note = derived and/or modified protein sequence (wt) from HRSV__AHV81837.1__M2-1
MSRRNPCKFEIRGHCLNGRRCHYSHNYFEWPSHALLVRQNFMLNKILKSMDKSIDTLSEISGAAELDRTEEYALGIVGVLESYIGSINNITKQSACVAMSKLLIEISSDDIKKLRDNEEPNSPKIRVYNTVISYIESNRKNNKQTIHLLKRLPADVLKKTIKNTLDIHKSITISNPKESTISDQNDQTKNNDIT

SEQ ID NO: 11615 - protein, 194 aa, synthetic construct
  REGION 1..194: note = derived and/or modified protein sequence (wt) from HRSV__AHW80891.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKGITINNPKESTVNDTNDHAKNNDTT

SEQ ID NO: 11616 - protein, 194 aa, synthetic construct
  REGION 1..194: note = derived and/or modified protein sequence (wt) from HRSV__AHW80951.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELSSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11617 - protein, 194 aa, synthetic construct
  REGION 1..194: note = derived and/or modified protein sequence (wt) from HRSV__AHW80971.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVNDTNDHAKNNDTT

SEQ ID NO: 11618 - protein, 194 aa, synthetic construct
  REGION 1..194: note = derived and/or modified protein sequence (wt) from HRSV__AHW80991.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVTSYIESNRKNNKQTIHLLKRLPADVLKKTIKNTLDIHKSITINNPKESTVNDTNDHAKNNDTT

SEQ ID NO: 11619 - protein, 194 aa, synthetic construct
  REGION 1..194: note = derived and/or modified protein sequence (wt) from HRSV__AHW81241.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTA

SEQ ID NO: 11620 - protein, 194 aa, synthetic construct
  REGION 1..194: note = derived and/or modified protein sequence (wt) from HRSV__AHW81381.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKIITINNPKESTVSDTNDHAKNNDTT

SEQ ID NO: 11621 - protein, 194 aa, synthetic construct
  REGION 1..194: note = derived and/or modified protein sequence (wt) from HRSV__AHX56988.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNSKESTVSDQNDQTKNNDIT

SEQ ID NO: 11622 - protein, 194 aa, synthetic construct
  REGION 1..194: note = derived and/or modified protein sequence (wt) from HRSV__AHX57044.1__M2-1
MSRRNPCKFEIRGHCLNGRRCHYSHNYFEWPPHALLVRQNFILNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11623 - protein, 194 aa, synthetic construct
  REGION 1..194: note = derived and/or modified protein sequence (wt) from HRSV__AHX57241.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNSKESTVSDTNDHAKNNDTT

SEQ ID NO: 11624 - protein, 194 aa, synthetic construct
  REGION 1..194: note = derived and/or modified protein sequence (wt) from HRSV__AHX57615.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSNDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11625 - protein, 194 aa, synthetic construct
  REGION 1..194: note = derived and/or modified protein sequence (wt) from HRSV__AHY21156.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKRLRDNEEPNSPKIRVYNTVISYIESNRKNNKQTIHLLKRLPADVLKKTIKNTLDIHKSITINNPKESTVNDTNDHAKNNDTT

SEQ ID NO: 11626 - protein, 194 aa, synthetic construct
  REGION 1..194: note = derived and/or modified protein sequence (wt) from HRSV__AHY21201.1__M2-1
MSRRNPCKFEIRGHCLNGRRCHYSHNYFEWPHHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVSDQNDQTKNNDIT

SEQ ID NO: 11627 - protein, 194 aa, synthetic construct
  REGION 1..194: note = derived and/or modified protein sequence (wt) from HRSV__AHY21223.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVTSYIESNRKNNKQTIHLLKRLPADVLKKTIKNTLDIHKSITINNPKESADSDTNDHAKNNDTT

SEQ ID NO: 11628 - protein, 194 aa, synthetic construct
  REGION 1..194: note = derived and/or modified protein sequence (wt) from HRSV__AHY21255.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKRLRDNEEPNSPKIRVYNTVISYIESNRKNNKQTIHLLKRLPADVLKKTIKNTLDIHKSITINNPKESTVSDTNDHAKNNDTT

SEQ ID NO: 11629 - protein, 194 aa, synthetic construct
  REGION 1..194: note = derived and/or modified protein sequence (wt) from HRSV__AHY21354.1__M2-1
MSRRNPCKFEIRGHCLNGRRCHYSHNYFEWPSHALLVRQNFILNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVNDQNDQTKNNDIT

SEQ ID NO: 11630 - protein, 194 aa, synthetic construct
  REGION 1..194: note = derived and/or modified protein sequence (wt) from HRSV__AHY21365.1__M2-1
MSRRNPCKFEIRGHCLNGRRCHYSHNYFEWPSHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVNDQNDQTKNNDIT

SEQ ID NO: 11631 - protein, 194 aa, synthetic construct
  REGION 1..194: note = derived and/or modified protein sequence (wt) from HRSV__AHY21387.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKRLRDNEEPNSPKIRVYNTVISYIESNRKNNKQTIHLLKRLPADVLKKTIKNTLDIHKSITISNPKESTVSDQNDQTKNNDIT

SEQ ID NO: 11632 - protein, 194 aa, synthetic construct
  REGION 1..194: note = derived and/or modified protein sequence (wt) from HRSV__AHY21399.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKQRDNEEPNSPKIRVYNTVISYIESNRKNNKQTIHLLKRLPADVLKKTIKNTLDIHKNITISSSKESTVNDQNDQTKNNDIT

SEQ ID NO: 11633 - protein, 194 aa, synthetic construct
  REGION 1..194: note = derived and/or modified protein sequence (wt) from HRSV__AHY21432.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKELTVSNTNDHAKNNDTT

SEQ ID NO: 11634 - protein, 194 aa, synthetic construct
  REGION 1..194: note = derived and/or modified protein sequence (wt) from HRSV__AHY21442.1__M2-1
MSRRNPCKFEIRGHCLNGKRCHFNHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11635 - protein, 194 aa, synthetic construct
  REGION 1..194: note = derived and/or modified protein sequence (wt) from HRSV__AIA62796.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDAT

SEQ ID NO: 11636 - protein, 194 aa, synthetic construct
  REGION 1..194: note = derived and/or modified protein sequence (wt) from HRSV__AIA63155.1__M2-1
MSRRNPCKFEIRGHCLNGKRCHFSHNYFEWPPHALLVRQNFMLNRILKSMDKSIDTLSEISGAAELDRTEEFAHGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11637 - protein, 194 aa, synthetic construct
  REGION 1..194: note = derived and/or modified protein sequence (wt) from HRSV__AII22108.1__M2-1
MSRRNPCKFEIRGHCLNGKKCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11638 - protein, 194 aa, synthetic construct
  REGION 1..194: note = derived and/or modified protein sequence (wt) from HRSV__AII22130.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKARVYNTVISYIESNRKNNKQTIHLLKRLPADVLKKTIKNTLDIHKSITINNPKESTVSDTNDHAKNNDTT

SEQ ID NO: 11639 - protein, 194 aa, synthetic construct
  REGION 1..194: note = derived and/or modified protein sequence (wt) from HRSV__AIZ95509.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRNNEEPNSPKIRVYNTVTSYIESNRKNNKQTIHLLKRLPADVLKKTIKNTLDIHKSITINNPKESADSDTNDHAKNNDTT

SEQ ID NO: 11640 - protein, 194 aa, synthetic construct
  REGION 1..194: note = derived and/or modified protein sequence (wt) from HRSV__AIZ95696.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNSKESTVNDQNDQTKNNDIT

SEQ ID NO: 11641 - protein, 194 aa, synthetic construct
  REGION 1..194: note = derived and/or modified protein sequence (wt) from HRSV__AIZ95762.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITINNPKESTVNDQNDQTKNNDIT

SEQ ID NO: 11642 - protein, 194 aa, synthetic construct
  REGION 1..194: note = derived and/or modified protein sequence (wt) from HRSV__AIZ95828.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDTNNHAKNNDTT

SEQ ID NO: 11643 - protein, 194 aa, synthetic construct
  REGION 1..194: note = derived and/or modified protein sequence (wt) from HRSV__AIZ95927.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEESNSPKIRVYNTVISYIESNRKNNKQTIHLLKRLPADVLKKTIKNTLDIHKSITISNPKESTVNDQNDQTKNNDIT

SEQ ID NO: 11644 - protein, 194 aa, synthetic construct
  REGION 1..194: note = derived and/or modified protein sequence (wt) from HRSV__AIZ95938.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDTEEPNSPKIRVYNTVISYIESNRKNNKQTIHLLKRLPADVLKKTIKNTLDIHKSITINNPKESTVSDTNDHAKNNDTT

SEQ ID NO: 11645 - protein, 194 aa, synthetic construct
  REGION 1..194: note = derived and/or modified protein sequence (wt) from HRSV__AIZ95949.1__M2-1
MSQRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKQRDNEEPNSPKIRVYNTVISYIESNRKNNKQTIHLLKRLPADVLKKTIKNTLDIHKNITISNSKESTVNDQNDQTKNNDIT

SEQ ID NO: 11646 - protein, 194 aa, synthetic construct
  REGION 1..194: note = derived and/or modified protein sequence (wt) from HRSV__AIZ96004.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLKDTEEPNSPKIRVYNTVISYIESNRKNNKQTIHLLKRLPADVLKKTIKNTLDIHKSITINNPKESTVSDTDDHAKNNDTT

SEQ ID NO: 11647 - protein, 194 aa, synthetic construct
  REGION 1..194: note = derived and/or modified protein sequence (wt) from HRSV__AJF44527.1__M2-1
MSRRNPCKFEIRGHCLNGRRCHYSHNYFEWPSHALLVRQNFMLNKILKSMDKSIDTLSEISGAAELDRTEEYALGIVGVLESYIGSINNITKQSACVAMSKLLIEINSDDIKKLRDNEEPSSPKIRVYNTVISYIESNRKNNKQTIHLLKRLPADVLKKTIKNTLDIHKSITISNPKESTVSDHNDQTKNNDIT

SEQ ID NO: 11648 - protein, 194 aa, synthetic construct
  REGION 1..194: note = derived and/or modified protein sequence (wt) from HRSV__AJF44603.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQPKNNDIT

SEQ ID NO: 11649 - protein, 194 aa, synthetic construct
  REGION 1..194: note = derived and/or modified protein sequence (wt) from HRSV__AJF44726.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEETNSPKVRVYNTVISYIESNRKNNKQTIHLLKRLPADVLKKTIKNTLDIHKSITINNPKESTVSDTNDHAKNNDTT

SEQ ID NO: 11650 - protein, 194 aa, synthetic construct
  REGION 1..194: note = derived and/or modified protein sequence (wt) from HRSV__AJF44729.1__M2-1
MSRRNPCKFEIRGHCLNGERCHFSHNYFEWPPHALLVRQNFMLNRILKSMDKSIDTLSEISGAAELDRTEEYALGVVGVLESYIGSINNITKQSACVAMSKLLTELNSDDIKKLRDNEETNSPKVRVYNTVISYIESNRKNNKQTIHLLKRLPADVLKKTIKNTLDIHKSITINNPKESTVSDTNDHAKNNDTT

SEQ ID NO: 11651 - protein, 194 aa, synthetic construct
  REGION 1..194: note = derived and/or modified protein sequence (wt) from HRSV__AJF44827.1__M2-1
MSRRNPCKFEIRGHCLNGKRCHFSHNYFEWPPHALLVGQNFMLNRILKSMDKSIDTLSEISGAAELDRTEEYALGVVGVLESYIGSINNITKQSACVAMSKLLTELNSDDIKKLRDHEEPNSPKVRVYNTVISYIESNRKNNKQTIHLLKRLPADVLKKTIKNTLDIHKSITINNPKESTVSDTNDHAKNNDTT

SEQ ID NO: 11652 - protein, 194 aa, synthetic construct
  REGION 1..194: note = derived and/or modified protein sequence (wt) from HRSV__AJO16078.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHRSITISNPKESTISDQNDQTKNNDIT

SEQ ID NO: 11653 - protein, 194 aa, synthetic construct
  REGION 1..194: note = derived and/or modified protein sequence (wt) from HRSV__AJZ69870.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKVRVYNTVISYIESNRKNNKQTIHLLKRLPADVLKKTIKNTLDIHKSITINNPKESTVNDTNDHAKNNDTT

SEQ ID NO: 11654 - protein, 194 aa, synthetic construct
  REGION 1..194: note = derived and/or modified protein sequence (wt) from HRSV__AJZ70167.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDHEEPNSPKVRVYNTVISYIESNRKNNKQTIHLLKRLPADVLKKTIKNTLDIHKSITINNPKESTVSDTSDHAKNNDTT

SEQ ID NO: 11655 - protein, 194 aa, synthetic construct
  REGION 1..194: note = derived and/or modified protein sequence (wt) from HRSV__AKA45839.1__M2-1
MSRRNPCKFEIRGHCLNGRRCHYSHNYFEWPPHALLVRQNFMLNKILKSMDKSIDTLSEISGAAELDRTEEYALGIVGVLESYIGSVNNITKQSACVAMSKLLIEINSDDIKKLRDNEEPNSPKIRVYNTVISYIESNRKNNKQTIHLLKRLPADVLKKTIKNTLDIHKSITISNPKESTVSDQNDQTKNNDIT

SEQ ID NO: 11656 - protein, 194 aa, synthetic construct
  REGION 1..194: note = derived and/or modified protein sequence (wt) from HRSV__AKA45850.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITVSNPKESTVSEQNDQTKNNDIT

SEQ ID NO: 11657 - protein, 194 aa, synthetic construct
  REGION 1..194: note = derived and/or modified protein sequence (wt) from HRSV__ALC74026.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIRKLRDNEEPNSPKIRVYNTVISYIESNRKNSKQTIHLLKRLPADVLKKTIKNTLDIHKSITISNPKESTVSDQNDQTKNNDIT

SEQ ID NO: 11658 - protein, 194 aa, synthetic construct
  REGION 1..194: note = derived and/or modified protein sequence (wt) from HRSV__AMA66450.1__M2-1
MSRRNPCKFEIRGHCLNGRRCHYSHNYFEWPSHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVSDQNDQTKNNDIT

SEQ ID NO: 11659 - protein, 194 aa, synthetic construct
  REGION 1..194: note = derived and/or modified protein sequence (wt) from HRSV__AMA66559.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTFSDTNDHAKNNDTT

SEQ ID NO: 11660 - protein, 194 aa, synthetic construct
  REGION 1..194: note = derived and/or modified protein sequence (wt) from HRSV__AMA66570.1__M2-1
MSRRNPCKFEIRGHCLNGRRCHYSHNYFEWPHHALLVRQNFILNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVSDQNDQTKNNDIT

SEQ ID NO: 11661 - protein, 194 aa, synthetic construct
  REGION 1..194: note = derived and/or modified protein sequence (wt) from HRSV__AMA66581.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSVTINNPKELTVSDTNDHAKNNDTT

SEQ ID NO: 11662 - protein, 194 aa, synthetic construct
  REGION 1..194: note = derived and/or modified protein sequence (wt) from HRSV__AMA66625.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNTKQTIHLLKRLPADVLKKTIKNTLDIHKSITISNPKESTVNDQNDQTKNNDIT

SEQ ID NO: 11663 - protein, 194 aa, synthetic construct
  REGION 1..194: note = derived and/or modified protein sequence (wt) from HRSV__AMA66922.1__M2-1
MSRKNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSVTINNPKESTVGDTNDHAKNNDTT

SEQ ID NO: 11664 - protein, 194 aa, synthetic construct
  REGION 1..194: note = derived and/or modified protein sequence (wt) from HRSV__AMA66966.1__M2-1
MSRRNPCKFEIRGHCLNGRRCHYSHNYFEWPSHALLVRQNFMLNKILKSMDKSIDTLSEISGAAELDRTEEYALGIVGVLESYIGSINNITKQSACVAMSKLLIEINSDDIKKLKDNEEPNSPKIRVYNTVISYIESNRKNNKQTIHLLKRLPADVLKKTIKNTLDIHKSITISNPKESTVNDQNDQTKNNDIT

SEQ ID NO: 11665 - protein, 194 aa, synthetic construct
  REGION 1..194: note = derived and/or modified protein sequence (wt) from HRSV__AMA67087.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESIVSDQNDQTKNNDIT

SEQ ID NO: 11666 - protein, 194 aa, synthetic construct
  REGION 1..194: note = derived and/or modified protein sequence (wt) from HRSV__AMA67120.1__M2-1
MSRRNPCKFEIRGHCLNGKRCHFSHNYFEWPPHALLVRQNFMLNRILKSMDKSIDTLSEISGAAELDRTEEYALGVVGVLESYIESINNITKQSACVAMSKLLTELNSDDIKKLRDNEEPNSPKIRVYNTVISYIESNRKNNKQTIHLLKRLPADVLKKTIKNTLDIHKSITINNPKESTVNDTNDHAKNNDTT

SEQ ID NO: 11667 - protein, 194 aa, synthetic construct
  REGION 1..194: note = derived and/or modified protein sequence (wt) from HRSV__AMA67318.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEESNSPKIRVYNTVISYIESNRKNNKQTIHLLKRLPADVLKKTIKNTLDIHKSITISNPKESTVSDQNDQTKNNDIT

SEQ ID NO: 11668 - protein, 194 aa, synthetic construct
  REGION 1..194: note = derived and/or modified protein sequence (wt) from HRSV__AMA67329.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTINDTNDHAKNNDTT

SEQ ID NO: 11669 - protein, 194 aa, synthetic construct
  REGION 1..194: note = derived and/or modified protein sequence (wt) from HRSV__AMN91265.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTINDQNDQTKNNDIT

SEQ ID NO: 11670 - protein, 194 aa, synthetic construct
  REGION 1..194: note = derived and/or modified protein sequence (wt) from HRSV__AMN91386.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKVRVYNTVISYIESNRKNSKQTIHLLKRLPADVLKKTIKNTLDIHKSITISNPKESTVSDQNDQTKNNDIT

SEQ ID NO: 11671 - protein, 194 aa, synthetic construct
  REGION 1..194: note = derived and/or modified protein sequence (wt) from HRSV__AMN91397.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITISNPKESTVSDTNDHAKNNDTT

SEQ ID NO: 11672 - protein, 194 aa, synthetic construct
  REGION 1..194: note = derived and/or modified protein sequence (wt) from HRSV__AMT77370.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEISSDDIKKLRDNEEPNSPKIRVYNTVISYIESNRKNNKQTIHLLKRLPADVLKKTIKNTLDIHKGITISNPKESTISDQNDQTKNNDIT

SEQ ID NO: 11673 - protein, 194 aa, synthetic construct
  REGION 1..194: note = derived and/or modified protein sequence (wt) from HRSV__AMT77557.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINIPKESTVSDTNDHAKNNDTT

SEQ ID NO: 11674 - protein, 194 aa, synthetic construct
  REGION 1..194: note = derived and/or modified protein sequence (wt) from HRSV__AMT77733.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYSTVISYIESNRKNNKQTIHLLKRLPADVLKKTIKNTLDIHKSITINNPKESTVSDTNDHAKNNDTT

SEQ ID NO: 11675 - protein, 194 aa, synthetic construct
  REGION 1..194: note = derived and/or modified protein sequence (wt) from HRSV__AMT77755.1__M2-1
MSRRNPCKFEIRGHCLNGKRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11676 - protein, 194 aa, synthetic construct
  REGION 1..194: note = derived and/or modified protein sequence (wt) from HRSV__AMT77810.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLKDNEEPNSPKVRVYNTVISYIESNRKNNKQTIHLLKRLPADVLKKTIKNTLDIHKSITINNPKESTVSDTNDHAKNNDTT

SEQ ID NO: 11677 - protein, 194 aa, synthetic construct
  REGION 1..194: note = derived and/or modified protein sequence (wt) from HRSV__AMT77920.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNQKESTVSDTNDHAKNNDTT

SEQ ID NO: 11678 - protein, 194 aa, synthetic construct
  REGION 1..194: note = derived and/or modified protein sequence (wt) from HRSV__AMT78008.1__M2-1
MSRRNPCKFEIRGHCLNGRRCHYSHNYFEWPPHALLVRQNFMLNKILKSMDKSIDTLSEISGADELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11679 - protein, 194 aa, synthetic construct
  REGION 1..194: note = derived and/or modified protein sequence (wt) from HRSV__AMT78096.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIYLLKRLPADVLKKTIKNTLDIHKSITISNPKESTVSDQNDQTKNNDIT

SEQ ID NO: 11680 - protein, 194 aa, synthetic construct
  REGION 1..194: note = derived and/or modified protein sequence (wt) from HRSV__AMT78217.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKCITINNPKESTVSDTNDHAKNNDTT

SEQ ID NO: 11681 - protein, 194 aa, synthetic construct
  REGION 1..194: note = derived and/or modified protein sequence (wt) from HRSV__AMT78305.1__M2-1
MSQRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11682 - protein, 194 aa, synthetic construct
  REGION 1..194: note = derived and/or modified protein sequence (wt) from HRSV__AMT78360.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPSSPKVRVYNTVISYIESNRKNNKQTIHLLKRLPADVLKKTIKNTLDIHKSITINNPKESTVSDTNDHAKNNDTT

SEQ ID NO: 11683 - protein, 194 aa, synthetic construct
  REGION 1..194: note = derived and/or modified protein sequence (wt) from HRSV__AMT78800.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMNKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11684 - protein, 194 aa, synthetic construct
  REGION 1..194: note = derived and/or modified protein sequence (wt) from HRSV__AMT78833.1__M2-1
MSRRNPCKFEIRGHCLNGKRCHFSHNYFEWPPHALLVRQNFILNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11685 - protein, 194 aa, synthetic construct
  REGION 1..194: note = derived and/or modified protein sequence (wt) from HRSV__AMT79862.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEVNSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11686 - protein, 194 aa, synthetic construct
  REGION 1..194: note = derived and/or modified protein sequence (wt) from HRSV__AMT79907.1__M2-1
MSRRNPCKFEIRGHCLNGKRCHFSHNYFEWPPHALLVRQNFMLNKILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11687 - protein, 194 aa, synthetic construct
  REGION 1..194: note = derived and/or modified protein sequence (wt) from HRSV__ANZ80013.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEQNSPKVRVYNTVISYIESNRKNNKQTIHLLKRLPADVLKKTIKNTLDIHKSITINNPKESTVSDTNDHAKNNDTT

SEQ ID NO: 11688 - protein, 194 aa, synthetic construct
  REGION 1..194: note = derived and/or modified protein sequence (wt) from HRSV__ANZ80035.1__M2-1
MSRRNPCKFEIRGHCLNGKRCHYSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINNPKESTVSDTNDHAKNNDTT

SEQ ID NO: 11689 - protein, 194 aa, synthetic construct
  REGION 1..194: note = derived and/or modified protein sequence (wt) from HRSV__ANZ80244.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINGDDIKRLRDNEEPNSPKIRVYNTVISYIESNRKNSKQTIHLLKRLPADVLKKTIKNTLDIHKSITISNPKESTISDQNDQTKNNDIT

SEQ ID NO: 11690 - protein, 194 aa, synthetic construct
  REGION 1..194: note = derived and/or modified protein sequence (wt) from HRSV__ANZ80354.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITMSNPKESTISDQNDQTKNNDIT

SEQ ID NO: 11691 - protein, 194 aa, synthetic construct
  REGION 1..194: note = derived and/or modified protein sequence (wt) from HRSV__ANZ80376.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITINNPKESTVSDQNDQTKNNDIT

SEQ ID NO: 11692 - protein, 194 aa, synthetic construct
  REGION 1..194: note = derived and/or modified protein sequence (wt) from HRSV__ANZ80453.1__M2-1
MSRRNPCKFEIRGHCLNGRRCHYSHNYFEWPPHALLVRQNFMLSKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11693 - protein, 194 aa, synthetic construct
  REGION 1..194: note = derived and/or modified protein sequence (wt) from HRSV__ANZ80475.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRKNNKQTIHLLKRLPADVLKKTIKNTLDIHKSITINSPKESTVSDTNDHAKNNDTT

SEQ ID NO: 11694 - protein, 194 aa, synthetic construct
  REGION 1..194: note = derived and/or modified protein sequence (wt) from HRSV__AOD41040.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDHEEPNSPKIRVYNTVISYIESNRKNNKQTIHLLKRLPADVLKKTIKNTLDIHKSITINNPKESTVSDTNDHAKNNDTT

SEQ ID NO: 11695 - protein, 194 aa, synthetic construct
  REGION 1..194: note = derived and/or modified protein sequence (wt) from HRSV__AOS48200.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKVRVYNTVISYIESNRKNNKQTIHLLKRLPADVLKKTIKNTLDIHKSITINNPKESTVSDTNDHAKNNDTT

SEQ ID NO: 11696 - protein, 194 aa, synthetic construct
  REGION 1..194: note = derived and/or modified protein sequence (wt) from HRSV__AOS48255.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSLKIRVYNTVISYIESNRKNNKQTIHLLKRLPADVLKKTIKNTLDIHKSITINNPKESTVNDTNDHAKNNDTT

SEQ ID NO: 11697 - protein, 194 aa, synthetic construct
  REGION 1..194: note = derived and/or modified protein sequence (wt) from HRSV__AOS48387.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISSPKESTVSDQNDQTKNNDIT

SEQ ID NO: 11698 - protein, 194 aa, synthetic construct
  REGION 1..194: note = derived and/or modified protein sequence (wt) from HRSV__AOS48420.1__M2-1
MSRRNPCKFEIRGHCLNGRRCHYSHNYFEWPPHALLVRQNFMLNKILKSMDKSIDTLSEISGAAELDRTEEYALGIIGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTISDQNDQTKNNDIT

SEQ ID NO: 11699 - protein, 194 aa, synthetic construct
  REGION 1..194: note = derived and/or modified protein sequence (wt) from HRSV__AOS48442.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYTESNRKNSKQTIHLLKRLPADVLKKTIKNTLDIHKSITISNPKESTVSDQNDQTKNNDIT

SEQ ID NO: 11700 - protein, 194 aa, synthetic construct
  REGION 1..194: note = derived and/or modified protein sequence (wt) from HRSV__API65187.1__M2-1
MARRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 11701 - protein, 194 aa, synthetic construct
  REGION 1..194: note = derived and/or modified protein sequence (wt) from HRSV__APW78670.1__M2-1
MSRRSPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYTESNRKNSKQTIHLLKRLPADVLKKTIKNTLDIHKSITISNPKESTVSDQNDQTKNNDIT

SEQ ID NO: 11702 - protein, 194 aa, synthetic construct
  REGION 1..194: note = derived and/or modified protein sequence (wt) from HRSV__APW78824.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHRSITISNPKESTVSDQNDQTKNNDIT

SEQ ID NO: 11703 - protein, 194 aa, synthetic construct
  REGION 1..194: note = derived and/or modified protein sequence (wt) from HRSV__ARB07906.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKELTISDQNDQTKNNDIT

SEQ ID NO: 11704 - protein, 194 aa, synthetic construct
  REGION 1..194: note = derived and/or modified protein sequence (wt) from HRSV__ARB66395.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVISYIESNRRNNKQTIHLLKRLPADVLKKTIKNTLDIHKSITINNPKESTVSDTNDHAKNNDTT

SEQ ID NO: 11705 - protein, 194 aa, synthetic construct
  REGION 1..194: note = derived and/or modified protein sequence (wt) from HRSV__ARB66417.1__M2-1
MSRRSPCKFEIRGHCLNGKRCHFSHNYFEWPPHALLVRQNFMLNRILKSMDKSIDTLSEISGAAELDRTEEYALGVVGVLESYIGSINNITKQSACVAMSKLLIELNSDDIKKLKDNEEPNSPKVRVYNTVISYIESNRKNNKQTIHLLKRLPADVLKKTIKNTLDIHKSITINNPKESTVSDTNDHAKNNDTT

SEQ ID NO: 11706 - protein, 194 aa, synthetic construct
  REGION 1..194: note = derived and/or modified protein sequence (wt) from HRSV__ARB66439.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVKVYNTVISYIESNRKNNKQTIHLLKRLPADVLKKTIKNTLDIHKSITINNPKESTVSDTNDHAKNNDTT

SEQ ID NO: 11707 - protein, 194 aa, synthetic construct
  REGION 1..194: note = derived and/or modified protein sequence (wt) from HRSV__ARN61508.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNGDDIKKLRDNEEPNSPKVRVYNTVISYIESNRKNNKQTIHLLKRLPADVLKKTIKNTLDTHKSITINNPKESTVSDTNDHAKNNDTT

SEQ ID NO: 11708 - protein, 194 aa, synthetic construct
  REGION 1..194: note = derived and/or modified protein sequence (wt) from HRSV__ART28318.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVNDANDHAKNNDTT

SEQ ID NO: 11709 - protein, 194 aa, synthetic construct
  REGION 1..194: note = derived and/or modified protein sequence (wt) from HRSV__ART28362.1__M2-1
MSRRNPCKFEIRGHCLNGKRCHFSHNYFEWPPHALLVRQNFMLNRILKSMDKSIDALSEISGAAELDRTEEYALGVVGVLESYIGSINNITKQSACVAMSKLLTELNSDDIKKLRDHEEPNSPKVRVYNTVISYIESNRKNNKQTIHLLKRLPADVLKKTIKNTLDIHKSITINNPKESTVSDTNDHAKNNDTT

SEQ ID NO: 11710 - protein, 194 aa, synthetic construct
  REGION 1..194: note = derived and/or modified protein sequence (wt) from HRSV__ART28373.1__M2-1
MSRRNPCKFEIRGHCLNGRRCHYSHNYFEWPPHALLVRQNFMLNKILKSMDKSIDTLSEISGAAELDRTEEYALGIIGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQTKNNDIT

SEQ ID NO: 11711 - protein, 194 aa, synthetic construct
  REGION 1..194: note = derived and/or modified protein sequence (wt) from HRSV__ART28417.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKTIKNTLDIHKSITISNPKESTVSDQNDQAKNNDIT

SEQ ID NO: 11712 - protein, 194 aa, synthetic construct
  REGION 1..194: note = derived and/or modified protein sequence (wt) from HRSV__ASK05521.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNSKQTIHLLKRLPADVLKKAIKNTLDIHKSITISNPKESTISDQNDQTKNNDIT

SEQ ID NO: 11713 - protein, 194 aa, synthetic construct
  REGION 1..194: note = derived and/or modified protein sequence (wt) from HRSV__ASZ70100.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKRLRDHEEPNSPKVRVYNTVISYIESNRKNNKQTIHLLKRLPADVLKKTIKNTLDIHKSITINNPKESTVSDTNDHAKNNDTT

SEQ ID NO: 11714 - protein, 194 aa, synthetic construct
  REGION 1..194: note = derived and/or modified protein sequence (wt) from HRSV__ASZ84932.1__M2-1
MSRRNPCKFEIRGHCLNGRRCHYSHNYFEWPSHALLVRQNFMLNKILKSMDKSIDTLSEISGAAELDRTEEYALGIVGVLESYIGSINNITKQSACVAMSKLLIEINSDDIKKLRDNEEPSSPKIRVYNTVISYIESNRKNNKQTIHLLKRLPADVLKKTIKNTLDIHKGITISNPKESTVSDHNDQTKNNDIT

SEQ ID NO: 11715 - protein, 194 aa, synthetic construct
  REGION 1..194: note = derived and/or modified protein sequence (wt) from HRSV__ATV81300.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINGDDIKKLRDNEEPNSPKIRVYNTVISYIESNRKNSKQTIHLLKRLPADVLKKTIKNTLDIHKSITISNPKESTISDQNDQTKNNDIT

SEQ ID NO: 11716 - protein, 194 aa, synthetic construct
  REGION 1..194: note = derived and/or modified protein sequence (wt) from HRSV__ATV81355.1__M2-1
MSEKYPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKVRVYNTVTSYIESNRKNNKQTIHLLKRLPADVLKKTIKNTLDIHKSITINNPKESTVSDTNDHAKNNDTT

SEQ ID NO: 11717 - protein, 194 aa, synthetic construct
  REGION 1..194: note = derived and/or modified protein sequence (wt) from HRSV__AUC68446.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVGDTNDHAKNNDTT

SEQ ID NO: 11718 - protein, 194 aa, synthetic construct
  REGION 1..194: note = derived and/or modified protein sequence (wt) from HRSV__AUC68523.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSITINNPKESTVSDPNDHAKNNDTT

SEQ ID NO: 11719 - protein, 194 aa, synthetic construct
  REGION 1..194: note = derived and/or modified protein sequence (wt) from HRSV__AUC68556.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKNTLDIHKSVTINNPKESTISDTNDHAKNNDTT

SEQ ID NO: 11720 - protein, 194 aa, synthetic construct
  REGION 1..194: note = derived and/or modified protein sequence (wt) from HRSV__AUC68567.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKELTVSDTNDHTKNNDTT

SEQ ID NO: 11721 - protein, 194 aa, synthetic construct
  REGION 1..194: note = derived and/or modified protein sequence (wt) from HRSV__AUC68579.1__M2-1
MSRRNPCKFEIRGHCLNGRRCHYSHNYFEWPPHALLVRQNFMLNRILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSITISNPKESTVNDQNDQTKNNDIT

SEQ ID NO: 11722 - protein, 194 aa, synthetic construct
  REGION 1..194: note = derived and/or modified protein sequence (wt) from HRSV__AUH26190.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKIRDNEEPNSPKIRVYNTVISYIESNRKNNKQTIHLLKRLPADVLKKTIKNTLDIHKSITINNPKESTVNDTNDHAKNNDTT

SEQ ID NO: 11723 - protein, 194 aa, synthetic construct
  REGION 1..194: note = derived and/or modified protein sequence (wt) from HRSV__NP_044597.1__M2-1
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEEPNSPKIRVYNTVISYIESNRKNNKQTIHLLKRLPADVLKKTIKTTLDIHKSITINNPKESTVSDINDHAKNNDTT

SEQ ID NO: 11724 - protein, 194 aa, synthetic construct
  REGION 1..194: note = derived and/or modified protein sequence (wt) from HRSV__NP_056864.1__M2-1
MSRRNPCKFEIRGHCLNGRRCHYSHNYFEWPPHALLVRQNFMLNKILKSMDKSIDTLSEISGAAELDRTEEYALGIVGVLESYIGSINNITKQSACVAMSKLLIEINSDDIKKLRDNEEPNSPKIRVYNTVISYIESNRKNNKQTIHLLKRLPADVLKKTIKNTLDIHKSIIISNPKESTVNDQNDQTKNNDIT

SEQ ID NO: 11725 - protein, 194 aa, synthetic construct
  REGION 1..194: note = derived and/or modified protein sequence (wt) from HRSV__4C3E_A__M2-1
MSRRNPCKFEIRGHCLNGKRCHFSHNYFEWPPHALLVRQNFMLNRILKSMDKSIDTLDEIDGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 11726 - protein, 574 aa, synthetic construct; identical to SEQ ID NO: 8937
  REGION 1..574: note = derived and/or modified protein sequence (wt) from HRSV(Memphis-37)__AIY60640.1__F0

SEQ ID NO: 11727 - RNA, 1725 nt, synthetic construct
  misc_feature 1..1725: note = derived and/or modified CDS sequence (wt) from HRSV(Memphis-37)__AIY60640.1__F0
  source 1..1725: mol_type = other RNA
atggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactga

SEQ ID NO: 11728 - RNA, 1725 nt, synthetic construct
  misc_feature 1..1725: note = derived and/or modified CDS sequence (opt1) from HRSV(Memphis-37)__AIY60640.1__F0
  source 1..1725: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 11729 - RNA, 1725 nt, synthetic construct
  misc_feature 1..1725: note = derived and/or modified CDS sequence (opt2) from HRSV(Memphis-37)__AIY60640.1__F0
  source 1..1725: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 11730 - RNA, 1725 nt, synthetic construct
  misc_feature 1..1725: note = derived and/or modified CDS sequence (opt3) from HRSV(Memphis-37)__AIY60640.1__F0
  source 1..1725: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactga

SEQ ID NO: 11731 - RNA, 1725 nt, synthetic construct
  misc_feature 1..1725: note = derived and/or modified CDS sequence (opt4) from HRSV(Memphis-37)__AIY60640.1__F0
  source 1..1725: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 11732 - RNA, 1725 nt, synthetic construct
  misc_feature 1..1725: note = derived and/or modified CDS sequence (opt5) from HRSV(Memphis-37)__AIY60640.1__F0
  source 1..1725: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactga

SEQ ID NO: 11733 - RNA, 1725 nt, synthetic construct
  misc_feature 1..1725: note = derived and/or modified CDS sequence (opt6) from HRSV(Memphis-37)__AIY60640.1__F0
  source 1..1725: mol_type = other RNA
atggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaa

SEQ ID NO: 11734 - RNA, 1725 nt, synthetic construct
  misc_feature 1..1725: note = derived and/or modified CDS sequence (opt11) from HRSV(Memphis-37)__AIY60640.1__F0
  source 1..1725: mol_type = other RNA
atggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaa

SEQ ID NO: 11735 - RNA, 2001 nt, synthetic construct
  misc_feature 1..2001: note = mRNA product Design a-1 comprising derived and/or modified sequence from HRSV(Memphis-37)__AIY60640.1__F0 (wt)
  source 1..2001: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11736 - RNA, 2001 nt, synthetic construct
  misc_feature 1..2001: note = mRNA product Design a-1 comprising derived and/or modified sequence from HRSV(Memphis-37)__AIY60640.1__F0 (opt1)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11737 - RNA, 2001 nt, synthetic construct
  misc_feature 1..2001: note = mRNA product Design a-1 comprising derived and/or modified sequence from HRSV(Memphis-37)__AIY60640.1__F0 (opt2)
  source 1..2001: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11738 - RNA, 2001 nt, synthetic construct
  misc_feature 1..2001: note = mRNA product Design a-1 comprising derived and/or modified sequence from HRSV(Memphis-37)__AIY60640.1__F0 (opt3)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11739 - RNA, 2001 nt, synthetic construct
  misc_feature 1..2001: note = mRNA product Design a-1 comprising derived and/or modified sequence from HRSV(Memphis-37)__AIY60640.1__F0 (opt4)
  source 1..2001: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11740 - RNA, 2001 nt, synthetic construct
  misc_feature 1..2001: note = mRNA product Design a-1 comprising derived and/or modified sequence from HRSV(Memphis-37)__AIY60640.1__F0 (opt5)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11741 - RNA, 2001 nt, synthetic construct
  misc_feature 1..2001: note = mRNA product Design a-1 comprising derived and/or modified sequence from HRSV(Memphis-37)__AIY60640.1__F0 (opt6)
  source 1..2001: mol_type = other RNA
gggagagtcccgcagtcggcgtccagcggctctgcttgttcgtgtgtgtgtcgttgcaggccttattcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11742 - RNA, 2001 nt, synthetic construct
  misc_feature 1..2001: note = mRNA product Design a-1 comprising derived and/or modified sequence from HRSV(Memphis-37)__AIY60640.1__F0 (opt11)
  source 1..2001: mol_type = other RNA
gggagagtcccgcagtcggcgtccagcggctctgcttgttcgtgtgtgtgtcgttgcaggccttattcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11743 - RNA, 2020 nt, synthetic construct
  misc_feature 1..2020: note = mRNA product Design a-2 comprising derived and/or modified sequence from HRSV(Memphis-37)__AIY60640.1__F0 (wt)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11744 - RNA, 2020 nt, synthetic construct
  misc_feature 1..2020: note = mRNA product Design a-2 comprising derived and/or modified sequence from HRSV(Memphis-37)__AIY60640.1__F0 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11745 - RNA, 2020 nt, synthetic construct
  misc_feature 1..2020: note = mRNA product Design a-2 comprising derived and/or modified sequence from HRSV(Memphis-37)__AIY60640.1__F0 (opt2)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11746 - RNA, 2020 nt, synthetic construct
  misc_feature 1..2020: note = mRNA product Design a-2 comprising derived and/or modified sequence from HRSV(Memphis-37)__AIY60640.1__F0 (opt3)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11747 - RNA, 2020 nt, synthetic construct
  misc_feature 1..2020: note = mRNA product Design a-2 comprising derived and/or modified sequence from HRSV(Memphis-37)__AIY60640.1__F0 (opt4)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11748 - RNA, 2020 nt, synthetic construct
  misc_feature 1..2020: note = mRNA product Design a-2 comprising derived and/or modified sequence from HRSV(Memphis-37)__AIY60640.1__F0 (opt5)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11749 - RNA, 2020 nt, synthetic construct
  misc_feature 1..2020: note = mRNA product Design a-2 comprising derived and/or modified sequence from HRSV(Memphis-37)__AIY60640.1__F0 (opt6)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11750 - RNA, 2020 nt, synthetic construct
  misc_feature 1..2020: note = mRNA product Design a-2 comprising derived and/or modified sequence from HRSV(Memphis-37)__AIY60640.1__F0 (opt11)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11751 - RNA, 2098 nt, synthetic construct
  misc_feature 1..2098: note = mRNA product Design a-3 comprising derived and/or modified sequence from HRSV(Memphis-37)__AIY60640.1__F0 (wt)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11752 - RNA, 2098 nt, synthetic construct
  misc_feature 1..2098: note = mRNA product Design a-3 comprising derived and/or modified sequence from HRSV(Memphis-37)__AIY60640.1__F0 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11753 - RNA, 2098 nt, synthetic construct
  misc_feature 1..2098: note = mRNA product Design a-3 comprising derived and/or modified sequence from HRSV(Memphis-37)__AIY60640.1__F0 (opt2)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11754 - RNA, 2098 nt, synthetic construct
  misc_feature 1..2098: note = mRNA product Design a-3 comprising derived and/or modified sequence from HRSV(Memphis-37)__AIY60640.1__F0 (opt3)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11755 - RNA, 2098 nt, synthetic construct
  misc_feature 1..2098: note = mRNA product Design a-3 comprising derived and/or modified sequence from HRSV(Memphis-37)__AIY60640.1__F0 (opt4)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11756 - RNA, 2098 nt, synthetic construct
  misc_feature 1..2098: note = mRNA product Design a-3 comprising derived and/or modified sequence from HRSV(Memphis-37)__AIY60640.1__F0 (opt5)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11757 - RNA, 2098 nt, synthetic construct
  misc_feature 1..2098: note = mRNA product Design a-3 comprising derived and/or modified sequence from HRSV(Memphis-37)__AIY60640.1__F0 (opt6)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11758 - RNA, 2098 nt, synthetic construct
  misc_feature 1..2098: note = mRNA product Design a-3 comprising derived and/or modified sequence from HRSV(Memphis-37)__AIY60640.1__F0 (opt11)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11759 - RNA, 2047 nt, synthetic construct
  misc_feature 1..2047: note = mRNA product Design a-4 comprising derived and/or modified sequence from HRSV(Memphis-37)__AIY60640.1__F0 (wt)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11760 - RNA, 2047 nt, synthetic construct
  misc_feature 1..2047: note = mRNA product Design a-4 comprising derived and/or modified sequence from HRSV(Memphis-37)__AIY60640.1__F0 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11761 - RNA, 2047 nt, synthetic construct
  misc_feature 1..2047: note = mRNA product Design a-4 comprising derived and/or modified sequence from HRSV(Memphis-37)__AIY60640.1__F0 (opt2)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11762 - RNA, 2047 nt, synthetic construct
  misc_feature 1..2047: note = mRNA product Design a-4 comprising derived and/or modified sequence from HRSV(Memphis-37)__AIY60640.1__F0 (opt3)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11763 - RNA, 2047 nt, synthetic construct
  misc_feature 1..2047: note = mRNA product Design a-4 comprising derived and/or modified sequence from HRSV(Memphis-37)__AIY60640.1__F0 (opt4)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11764 - RNA, 2047 nt, synthetic construct
  misc_feature 1..2047: note = mRNA product Design a-4 comprising derived and/or modified sequence from HRSV(Memphis-37)__AIY60640.1__F0 (opt5)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11765 - RNA, 2047 nt, synthetic construct
  misc_feature 1..2047: note = mRNA product Design a-4 comprising derived and/or modified sequence from HRSV(Memphis-37)__AIY60640.1__F0 (opt6)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11766 - RNA, 2047 nt, synthetic construct
  misc_feature 1..2047: note = mRNA product Design a-4 comprising derived and/or modified sequence from HRSV(Memphis-37)__AIY60640.1__F0 (opt11)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11767 - RNA, 1993 nt, synthetic construct
  misc_feature 1..1993: note = mRNA product Design a-5 comprising derived and/or modified sequence from HRSV(Memphis-37)__AIY60640.1__F0 (wt)
  source 1..1993: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11768 - RNA, 1993 nt, synthetic construct
  misc_feature 1..1993: note = mRNA product Design a-5 comprising derived and/or modified sequence from HRSV(Memphis-37)__AIY60640.1__F0 (opt1)
  source 1..1993: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11769 - RNA, 1993 nt, synthetic construct
  misc_feature 1..1993: note = mRNA product Design a-5 comprising derived and/or modified sequence from HRSV(Memphis-37)__AIY60640.1__F0 (opt2)
  source 1..1993: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11770 - RNA, 1993 nt, synthetic construct
  misc_feature 1..1993: note = mRNA product Design a-5 comprising derived and/or modified sequence from HRSV(Memphis-37)__AIY60640.1__F0 (opt3)
  source 1..1993: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11771 - RNA, 1993 nt, synthetic construct
  misc_feature 1..1993: note = mRNA product Design a-5 comprising derived and/or modified sequence from HRSV(Memphis-37)__AIY60640.1__F0 (opt4)
  source 1..1993: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11772 - RNA, 1993 nt, synthetic construct
  misc_feature 1..1993: note = mRNA product Design a-5 comprising derived and/or modified sequence from HRSV(Memphis-37)__AIY60640.1__F0 (opt5)
  source 1..1993: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11773 - RNA, 1993 nt, synthetic construct
  misc_feature 1..1993: note = mRNA product Design a-5 comprising derived and/or modified sequence from HRSV(Memphis-37)__AIY60640.1__F0 (opt6)
  source 1..1993: mol_type = other RNA
gggagactttcccattctgtagcagaatttggtgttgcctgtggtcttggtcccgcggagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11774 - RNA, 1993 nt, synthetic construct
  misc_feature 1..1993: note = mRNA product Design a-5 comprising derived and/or modified sequence from HRSV(Memphis-37)__AIY60640.1__F0 (opt11)
  source 1..1993: mol_type = other RNA
gggagactttcccattctgtagcagaatttggtgttgcctgtggtcttggtcccgcggagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11775 - RNA, 2174 nt, synthetic construct
  misc_feature 1..2174: note = mRNA product Design b-1 comprising derived and/or modified sequence from HRSV(Memphis-37)__AIY60640.1__F0 (wt)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11776 - RNA, 2174 nt, synthetic construct
  misc_feature 1..2174: note = mRNA product Design b-1 comprising derived and/or modified sequence from HRSV(Memphis-37)__AIY60640.1__F0 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11777 - RNA, 2174 nt, synthetic construct
  misc_feature 1..2174: note = mRNA product Design b-1 comprising derived and/or modified sequence from HRSV(Memphis-37)__AIY60640.1__F0 (opt2)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11778 - RNA, 2174 nt, synthetic construct
  misc_feature 1..2174: note = mRNA product Design b-1 comprising derived and/or modified sequence from HRSV(Memphis-37)__AIY60640.1__F0 (opt3)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11779 - RNA, 2174 nt, synthetic construct
  misc_feature 1..2174: note = mRNA product Design b-1 comprising derived and/or modified sequence from HRSV(Memphis-37)__AIY60640.1__F0 (opt4)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11780 - RNA, 2174 nt, synthetic construct
  misc_feature 1..2174: note = mRNA product Design b-1 comprising derived and/or modified sequence from HRSV(Memphis-37)__AIY60640.1__F0 (opt5)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11781 - RNA, 2174 nt, synthetic construct
  misc_feature 1..2174: note = mRNA product Design b-1 comprising derived and/or modified sequence from HRSV(Memphis-37)__AIY60640.1__F0 (opt6)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11782 - RNA, 2174 nt, synthetic construct
  misc_feature 1..2174: note = mRNA product Design b-1 comprising derived and/or modified sequence from HRSV(Memphis-37)__AIY60640.1__F0 (opt11)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11783 - RNA, 1994 nt, synthetic construct
  misc_feature 1..1994: note = mRNA product Design b-2 comprising derived and/or modified sequence from HRSV(Memphis-37)__AIY60640.1__F0 (wt)
  source 1..1994: mol_type = other RNA
gggagagcctctgctggagtccggggagtggcgttggctgctagagcgaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11784 - RNA, 1994 nt, synthetic construct
  misc_feature 1..1994: note = mRNA product Design b-2 comprising derived and/or modified sequence from HRSV(Memphis-37)__AIY60640.1__F0 (opt1)
  source 1..1994: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11785 - RNA, 1994 nt, synthetic construct
  misc_feature 1..1994: note = mRNA product Design b-2 comprising derived and/or modified sequence from HRSV(Memphis-37)__AIY60640.1__F0 (opt2)
  source 1..1994: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11786 - RNA, 1994 nt, synthetic construct
  misc_feature 1..1994: note = mRNA product Design b-2 comprising derived and/or modified sequence from HRSV(Memphis-37)__AIY60640.1__F0 (opt3)
  source 1..1994: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11787 - RNA, 1994 nt, synthetic construct
  misc_feature 1..1994: note = mRNA product Design b-2 comprising derived and/or modified sequence from HRSV(Memphis-37)__AIY60640.1__F0 (opt4)
  source 1..1994: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11788 - RNA, 1994 nt, synthetic construct
  misc_feature 1..1994: note = mRNA product Design b-2 comprising derived and/or modified sequence from HRSV(Memphis-37)__AIY60640.1__F0 (opt5)
  source 1..1994: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11789 - RNA, 1994 nt, synthetic construct
  misc_feature 1..1994: note = mRNA product Design b-2 comprising derived and/or modified sequence from HRSV(Memphis-37)__AIY60640.1__F0 (opt6)
  source 1..1994: mol_type = other RNA
gggagagcctctgctggagtccggggagtggcgttggctgctagagcgaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11790 - RNA, 1994 nt, synthetic construct
  misc_feature 1..1994: note = mRNA product Design b-2 comprising derived and/or modified sequence from HRSV(Memphis-37)__AIY60640.1__F0 (opt11)
  source 1..1994: mol_type = other RNA
gggagagcctctgctggagtccggggagtggcgttggctgctagagcgaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11791 - RNA, 2014 nt, synthetic construct
  misc_feature 1..2014: note = mRNA product Design b-3 comprising derived and/or modified sequence from HRSV(Memphis-37)__AIY60640.1__F0 (wt)
  source 1..2014: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11792 - RNA, 2014 nt, synthetic construct
  misc_feature 1..2014: note = mRNA product Design b-3 comprising derived and/or modified sequence from HRSV(Memphis-37)__AIY60640.1__F0 (opt1)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11793 - RNA, 2014 nt, synthetic construct
  misc_feature 1..2014: note = mRNA product Design b-3 comprising derived and/or modified sequence from HRSV(Memphis-37)__AIY60640.1__F0 (opt2)
  source 1..2014: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11794 - RNA, 2014 nt, synthetic construct
  misc_feature 1..2014: note = mRNA product Design b-3 comprising derived and/or modified sequence from HRSV(Memphis-37)__AIY60640.1__F0 (opt3)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11795 - RNA, 2014 nt, synthetic construct
  misc_feature 1..2014: note = mRNA product Design b-3 comprising derived and/or modified sequence from HRSV(Memphis-37)__AIY60640.1__F0 (opt4)
  source 1..2014: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11796 - RNA, 2014 nt, synthetic construct
  misc_feature 1..2014: note = mRNA product Design b-3 comprising derived and/or modified sequence from HRSV(Memphis-37)__AIY60640.1__F0 (opt5)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11797 - RNA, 2014 nt, synthetic construct
  misc_feature 1..2014: note = mRNA product Design b-3 comprising derived and/or modified sequence from HRSV(Memphis-37)__AIY60640.1__F0 (opt6)
  source 1..2014: mol_type = other RNA
gggagagtcccgcagtcggcgtccagcggctctgcttgttcgtgtgtgtgtcgttgcaggccttattcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11798 - RNA, 2014 nt, synthetic construct
  misc_feature 1..2014: note = mRNA product Design b-3 comprising derived and/or modified sequence from HRSV(Memphis-37)__AIY60640.1__F0 (opt11)
  source 1..2014: mol_type = other RNA
gggagagtcccgcagtcggcgtccagcggctctgcttgttcgtgtgtgtgtcgttgcaggccttattcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11799 - RNA, 2065 nt, synthetic construct
  misc_feature 1..2065: note = mRNA product Design b-4 comprising derived and/or modified sequence from HRSV(Memphis-37)__AIY60640.1__F0 (wt)
  source 1..2065: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11800 - RNA, 2065 nt, synthetic construct
  misc_feature 1..2065: note = mRNA product Design b-4 comprising derived and/or modified sequence from HRSV(Memphis-37)__AIY60640.1__F0 (opt1)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11801 - RNA, 2065 nt, synthetic construct
  misc_feature 1..2065: note = mRNA product Design b-4 comprising derived and/or modified sequence from HRSV(Memphis-37)__AIY60640.1__F0 (opt2)
  source 1..2065: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11802 - RNA, 2065 nt, synthetic construct
  misc_feature 1..2065: note = mRNA product Design b-4 comprising derived and/or modified sequence from HRSV(Memphis-37)__AIY60640.1__F0 (opt3)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11803 - RNA, 2065 nt, synthetic construct
  misc_feature 1..2065: note = mRNA product Design b-4 comprising derived and/or modified sequence from HRSV(Memphis-37)__AIY60640.1__F0 (opt4)
  source 1..2065: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11804 - RNA, 2065 nt, synthetic construct
  misc_feature 1..2065: note = mRNA product Design b-4 comprising derived and/or modified sequence from HRSV(Memphis-37)__AIY60640.1__F0 (opt5)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11805 - RNA, 2065 nt, synthetic construct
  misc_feature 1..2065: note = mRNA product Design b-4 comprising derived and/or modified sequence from HRSV(Memphis-37)__AIY60640.1__F0 (opt6)
  source 1..2065: mol_type = other RNA
gggagagtcccgcagtcggcgtccagcggctctgcttgttcgtgtgtgtgtcgttgcaggccttattcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11806 - RNA, 2065 nt, synthetic construct
  misc_feature 1..2065: note = mRNA product Design b-4 comprising derived and/or modified sequence from HRSV(Memphis-37)__AIY60640.1__F0 (opt11)
  source 1..2065: mol_type = other RNA
gggagagtcccgcagtcggcgtccagcggctctgcttgttcgtgtgtgtgtcgttgcaggccttattcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11807 - RNA, 2127 nt, synthetic construct
  misc_feature 1..2127: note = mRNA product Design b-5 comprising derived and/or modified sequence from HRSV(Memphis-37)__AIY60640.1__F0 (wt)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11808 - RNA, 2127 nt, synthetic construct
  misc_feature 1..2127: note = mRNA product Design b-5 comprising derived and/or modified sequence from HRSV(Memphis-37)__AIY60640.1__F0 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11809 - RNA, 2127 nt, synthetic construct
  misc_feature 1..2127: note = mRNA product Design b-5 comprising derived and/or modified sequence from HRSV(Memphis-37)__AIY60640.1__F0 (opt2)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11810 - RNA, 2127 nt, synthetic construct
  misc_feature 1..2127: note = mRNA product Design b-5 comprising derived and/or modified sequence from HRSV(Memphis-37)__AIY60640.1__F0 (opt3)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11811 - RNA, 2127 nt, synthetic construct
  misc_feature 1..2127: note = mRNA product Design b-5 comprising derived and/or modified sequence from HRSV(Memphis-37)__AIY60640.1__F0 (opt4)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11812 - RNA, 2127 nt, synthetic construct
  misc_feature 1..2127: note = mRNA product Design b-5 comprising derived and/or modified sequence from HRSV(Memphis-37)__AIY60640.1__F0 (opt5)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11813 - RNA, 2127 nt, synthetic construct
  misc_feature 1..2127: note = mRNA product Design b-5 comprising derived and/or modified sequence from HRSV(Memphis-37)__AIY60640.1__F0 (opt6)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11814 - RNA, 2127 nt, synthetic construct
  misc_feature 1..2127: note = mRNA product Design b-5 comprising derived and/or modified sequence from HRSV(Memphis-37)__AIY60640.1__F0 (opt11)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11815 - RNA, 2033 nt, synthetic construct
  misc_feature 1..2033: note = mRNA product Design c-1 comprising derived and/or modified sequence from HRSV(Memphis-37)__AIY60640.1__F0 (wt)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11816 - RNA, 2033 nt, synthetic construct
  misc_feature 1..2033: note = mRNA product Design c-1 comprising derived and/or modified sequence from HRSV(Memphis-37)__AIY60640.1__F0 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11817 - RNA, 2033 nt, synthetic construct
  misc_feature 1..2033: note = mRNA product Design c-1 comprising derived and/or modified sequence from HRSV(Memphis-37)__AIY60640.1__F0 (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11818 - RNA, 2033 nt, synthetic construct
  misc_feature 1..2033: note = mRNA product Design c-1 comprising derived and/or modified sequence from HRSV(Memphis-37)__AIY60640.1__F0 (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11819 - RNA, 2033 nt, synthetic construct
  misc_feature 1..2033: note = mRNA product Design c-1 comprising derived and/or modified sequence from HRSV(Memphis-37)__AIY60640.1__F0 (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11820 - RNA, 2033 nt, synthetic construct
  misc_feature 1..2033: note = mRNA product Design c-1 comprising derived and/or modified sequence from HRSV(Memphis-37)__AIY60640.1__F0 (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11821 - RNA, 2033 nt, synthetic construct
  misc_feature 1..2033: note = mRNA product Design c-1 comprising derived and/or modified sequence from HRSV(Memphis-37)__AIY60640.1__F0 (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11822 - RNA, 2033 nt, synthetic construct
  misc_feature 1..2033: note = mRNA product Design c-1 comprising derived and/or modified sequence from HRSV(Memphis-37)__AIY60640.1__F0 (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11823 - RNA, 2123 nt, synthetic construct
  misc_feature 1..2123: note = mRNA product Design c-2 comprising derived and/or modified sequence from HRSV(Memphis-37)__AIY60640.1__F0 (wt)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11824 - RNA, 2123 nt, synthetic construct
  misc_feature 1..2123: note = mRNA product Design c-2 comprising derived and/or modified sequence from HRSV(Memphis-37)__AIY60640.1__F0 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11825 - RNA, 2123 nt, synthetic construct
  misc_feature 1..2123: note = mRNA product Design c-2 comprising derived and/or modified sequence from HRSV(Memphis-37)__AIY60640.1__F0 (opt2)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11826 - RNA, 2123 nt, synthetic construct
  misc_feature 1..2123: note = mRNA product Design c-2 comprising derived and/or modified sequence from HRSV(Memphis-37)__AIY60640.1__F0 (opt3)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11827 - RNA, 2123 nt, synthetic construct
  misc_feature 1..2123: note = mRNA product Design c-2 comprising derived and/or modified sequence from HRSV(Memphis-37)__AIY60640.1__F0 (opt4)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11828 - RNA, 2123 nt, synthetic construct
  misc_feature 1..2123: note = mRNA product Design c-2 comprising derived and/or modified sequence from HRSV(Memphis-37)__AIY60640.1__F0 (opt5)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11829 - RNA, 2123 nt, synthetic construct
  misc_feature 1..2123: note = mRNA product Design c-2 comprising derived and/or modified sequence from HRSV(Memphis-37)__AIY60640.1__F0 (opt6)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11830 - RNA, 2123 nt, synthetic construct
  misc_feature 1..2123: note = mRNA product Design c-2 comprising derived and/or modified sequence from HRSV(Memphis-37)__AIY60640.1__F0 (opt11)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11831 - RNA, 2100 nt, synthetic construct
  misc_feature 1..2100: note = mRNA product Design c-3 comprising derived and/or modified sequence from HRSV(Memphis-37)__AIY60640.1__F0 (wt)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11832 - RNA, 2100 nt, synthetic construct
  misc_feature 1..2100: note = mRNA product Design c-3 comprising derived and/or modified sequence from HRSV(Memphis-37)__AIY60640.1__F0 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11833 - RNA, 2100 nt, synthetic construct
  misc_feature 1..2100: note = mRNA product Design c-3 comprising derived and/or modified sequence from HRSV(Memphis-37)__AIY60640.1__F0 (opt2)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11834 - RNA, 2100 nt, synthetic construct
  misc_feature 1..2100: note = mRNA product Design c-3 comprising derived and/or modified sequence from HRSV(Memphis-37)__AIY60640.1__F0 (opt3)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11835 - RNA, 2100 nt, synthetic construct
  misc_feature 1..2100: note = mRNA product Design c-3 comprising derived and/or modified sequence from HRSV(Memphis-37)__AIY60640.1__F0 (opt4)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11836 - RNA, 2100 nt, synthetic construct
  misc_feature 1..2100: note = mRNA product Design c-3 comprising derived and/or modified sequence from HRSV(Memphis-37)__AIY60640.1__F0 (opt5)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11837 - RNA, 2100 nt, synthetic construct
  misc_feature 1..2100: note = mRNA product Design c-3 comprising derived and/or modified sequence from HRSV(Memphis-37)__AIY60640.1__F0 (opt6)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11838 - RNA, 2100 nt, synthetic construct
  misc_feature 1..2100: note = mRNA product Design c-3 comprising derived and/or modified sequence from HRSV(Memphis-37)__AIY60640.1__F0 (opt11)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11839 - RNA, 2096 nt, synthetic construct
  misc_feature 1..2096: note = mRNA product Design c-4 comprising derived and/or modified sequence from HRSV(Memphis-37)__AIY60640.1__F0 (wt)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11840 - RNA, 2096 nt, synthetic construct
  misc_feature 1..2096: note = mRNA product Design c-4 comprising derived and/or modified sequence from HRSV(Memphis-37)__AIY60640.1__F0 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11841 - RNA, 2096 nt, synthetic construct
  misc_feature 1..2096: note = mRNA product Design c-4 comprising derived and/or modified sequence from HRSV(Memphis-37)__AIY60640.1__F0 (opt2)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11842 - RNA, 2096 nt, synthetic construct
  misc_feature 1..2096: note = mRNA product Design c-4 comprising derived and/or modified sequence from HRSV(Memphis-37)__AIY60640.1__F0 (opt3)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11843 - RNA, 2096 nt, synthetic construct
  misc_feature 1..2096: note = mRNA product Design c-4 comprising derived and/or modified sequence from HRSV(Memphis-37)__AIY60640.1__F0 (opt4)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11844 - RNA, 2096 nt, synthetic construct
  misc_feature 1..2096: note = mRNA product Design c-4 comprising derived and/or modified sequence from HRSV(Memphis-37)__AIY60640.1__F0 (opt5)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11845 - RNA, 2096 nt, synthetic construct
  misc_feature 1..2096: note = mRNA product Design c-4 comprising derived and/or modified sequence from HRSV(Memphis-37)__AIY60640.1__F0 (opt6)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11846 - RNA, 2096 nt, synthetic construct
  misc_feature 1..2096: note = mRNA product Design c-4 comprising derived and/or modified sequence from HRSV(Memphis-37)__AIY60640.1__F0 (opt11)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11847 - RNA, 2014 nt, synthetic construct
  misc_feature 1..2014: note = mRNA product Design c-5 comprising derived and/or modified sequence from HRSV(Memphis-37)__AIY60640.1__F0 (wt)
  source 1..2014: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11848 - RNA, 2014 nt, synthetic construct
  misc_feature 1..2014: note = mRNA product Design c-5 comprising derived and/or modified sequence from HRSV(Memphis-37)__AIY60640.1__F0 (opt1)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11849 - RNA, 2014 nt, synthetic construct
  misc_feature 1..2014: note = mRNA product Design c-5 comprising derived and/or modified sequence from HRSV(Memphis-37)__AIY60640.1__F0 (opt2)
  source 1..2014: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11850 - RNA, 2014 nt, synthetic construct
  misc_feature 1..2014: note = mRNA product Design c-5 comprising derived and/or modified sequence from HRSV(Memphis-37)__AIY60640.1__F0 (opt3)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11851 - RNA, 2014 nt, synthetic construct
  misc_feature 1..2014: note = mRNA product Design c-5 comprising derived and/or modified sequence from HRSV(Memphis-37)__AIY60640.1__F0 (opt4)
  source 1..2014: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11852 - RNA, 2014 nt, synthetic construct
  misc_feature 1..2014: note = mRNA product Design c-5 comprising derived and/or modified sequence from HRSV(Memphis-37)__AIY60640.1__F0 (opt5)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11853 - RNA, 2014 nt, synthetic construct
  misc_feature 1..2014: note = mRNA product Design c-5 comprising derived and/or modified sequence from HRSV(Memphis-37)__AIY60640.1__F0 (opt6)
  source 1..2014: mol_type = other RNA
gggagagcggctcggccattttgtcccagtcagtccggaggctgcggctgcagaagtaccgcctgcggagtaactgcaaagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11854 - RNA, 2014 nt, synthetic construct
  misc_feature 1..2014: note = mRNA product Design c-5 comprising derived and/or modified sequence from HRSV(Memphis-37)__AIY60640.1__F0 (opt11)
  source 1..2014: mol_type = other RNA
gggagagcggctcggccattttgtcccagtcagtccggaggctgcggctgcagaagtaccgcctgcggagtaactgcaaagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11855 - RNA, 2023 nt, synthetic construct
  misc_feature 1..2023: note = mRNA product Design d-1 comprising derived and/or modified sequence from HRSV(Memphis-37)__AIY60640.1__F0 (wt)
  source 1..2023: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11856 - RNA, 2023 nt, synthetic construct
  misc_feature 1..2023: note = mRNA product Design d-1 comprising derived and/or modified sequence from HRSV(Memphis-37)__AIY60640.1__F0 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11857 - RNA, 2023 nt, synthetic construct
  misc_feature 1..2023: note = mRNA product Design d-1 comprising derived and/or modified sequence from HRSV(Memphis-37)__AIY60640.1__F0 (opt2)
  source 1..2023: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11858 - RNA, 2023 nt, synthetic construct
  misc_feature 1..2023: note = mRNA product Design d-1 comprising derived and/or modified sequence from HRSV(Memphis-37)__AIY60640.1__F0 (opt3)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11859 - RNA, 2023 nt, synthetic construct
  misc_feature 1..2023: note = mRNA product Design d-1 comprising derived and/or modified sequence from HRSV(Memphis-37)__AIY60640.1__F0 (opt4)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11860 - RNA, 2023 nt, synthetic construct
  misc_feature 1..2023: note = mRNA product Design d-1 comprising derived and/or modified sequence from HRSV(Memphis-37)__AIY60640.1__F0 (opt5)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11861 - RNA, 2023 nt, synthetic construct
  misc_feature 1..2023: note = mRNA product Design d-1 comprising derived and/or modified sequence from HRSV(Memphis-37)__AIY60640.1__F0 (opt6)
  source 1..2023: mol_type = other RNA
gggagacccgtgacccggaagttgtacggctacgcgactttccctcccacaaaccctcgcgcccttcctttcctacttgggcccggcagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11862 - RNA, 2023 nt, synthetic construct
  misc_feature 1..2023: note = mRNA product Design d-1 comprising derived and/or modified sequence from HRSV(Memphis-37)__AIY60640.1__F0 (opt11)
  source 1..2023: mol_type = other RNA
gggagacccgtgacccggaagttgtacggctacgcgactttccctcccacaaaccctcgcgcccttcctttcctacttgggcccggcagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11863 - RNA, 2078 nt, synthetic construct
  misc_feature 1..2078: note = mRNA product Design d-2 comprising derived and/or modified sequence from HRSV(Memphis-37)__AIY60640.1__F0 (wt)
  source 1..2078: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11864 - RNA, 2078 nt, synthetic construct
  misc_feature 1..2078: note = mRNA product Design d-2 comprising derived and/or modified sequence from HRSV(Memphis-37)__AIY60640.1__F0 (opt1)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11865 - RNA, 2078 nt, synthetic construct
  misc_feature 1..2078: note = mRNA product Design d-2 comprising derived and/or modified sequence from HRSV(Memphis-37)__AIY60640.1__F0 (opt2)
  source 1..2078: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11866 - RNA, 2078 nt, synthetic construct
  misc_feature 1..2078: note = mRNA product Design d-2 comprising derived and/or modified sequence from HRSV(Memphis-37)__AIY60640.1__F0 (opt3)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11867 - RNA, 2078 nt, synthetic construct
  misc_feature 1..2078: note = mRNA product Design d-2 comprising derived and/or modified sequence from HRSV(Memphis-37)__AIY60640.1__F0 (opt4)
  source 1..2078: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11868 - RNA, 2078 nt, synthetic construct
  misc_feature 1..2078: note = mRNA product Design d-2 comprising derived and/or modified sequence from HRSV(Memphis-37)__AIY60640.1__F0 (opt5)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11869 - RNA, 2078 nt, synthetic construct
  misc_feature 1..2078: note = mRNA product Design d-2 comprising derived and/or modified sequence from HRSV(Memphis-37)__AIY60640.1__F0 (opt6)
  source 1..2078: mol_type = other RNA
gggagagcggctcggccattttgtcccagtcagtccggaggctgcggctgcagaagtaccgcctgcggagtaactgcaaagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11870 - RNA, 2078 nt, synthetic construct
  misc_feature 1..2078: note = mRNA product Design d-2 comprising derived and/or modified sequence from HRSV(Memphis-37)__AIY60640.1__F0 (opt11)
  source 1..2078: mol_type = other RNA
gggagagcggctcggccattttgtcccagtcagtccggaggctgcggctgcagaagtaccgcctgcggagtaactgcaaagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11871 - RNA, 2394 nt, synthetic construct
  misc_feature 1..2394: note = mRNA product Design d-3 comprising derived and/or modified sequence from HRSV(Memphis-37)__AIY60640.1__F0 (wt)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11872 - RNA, 2394 nt, synthetic construct
  misc_feature 1..2394: note = mRNA product Design d-3 comprising derived and/or modified sequence from HRSV(Memphis-37)__AIY60640.1__F0 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11873 - RNA, 2394 nt, synthetic construct
  misc_feature 1..2394: note = mRNA product Design d-3 comprising derived and/or modified sequence from HRSV(Memphis-37)__AIY60640.1__F0 (opt2)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11874 - RNA, 2394 nt, synthetic construct
  misc_feature 1..2394: note = mRNA product Design d-3 comprising derived and/or modified sequence from HRSV(Memphis-37)__AIY60640.1__F0 (opt3)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11875 - RNA, 2394 nt, synthetic construct
  misc_feature 1..2394: note = mRNA product Design d-3 comprising derived and/or modified sequence from HRSV(Memphis-37)__AIY60640.1__F0 (opt4)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11876 - RNA, 2394 nt, synthetic construct
  misc_feature 1..2394: note = mRNA product Design d-3 comprising derived and/or modified sequence from HRSV(Memphis-37)__AIY60640.1__F0 (opt5)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11877 - RNA, 2394 nt, synthetic construct
  misc_feature 1..2394: note = mRNA product Design d-3 comprising derived and/or modified sequence from HRSV(Memphis-37)__AIY60640.1__F0 (opt6)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11878 - RNA, 2394 nt, synthetic construct
  misc_feature 1..2394: note = mRNA product Design d-3 comprising derived and/or modified sequence from HRSV(Memphis-37)__AIY60640.1__F0 (opt11)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11879 - RNA, 2077 nt, synthetic construct
  misc_feature 1..2077: note = mRNA product Design d-4 comprising derived and/or modified sequence from HRSV(Memphis-37)__AIY60640.1__F0 (wt)
  source 1..2077: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11880 - RNA, 2077 nt, synthetic construct
  misc_feature 1..2077: note = mRNA product Design d-4 comprising derived and/or modified sequence from HRSV(Memphis-37)__AIY60640.1__F0 (opt1)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11881 - RNA, 2077 nt, synthetic construct
  misc_feature 1..2077: note = mRNA product Design d-4 comprising derived and/or modified sequence from HRSV(Memphis-37)__AIY60640.1__F0 (opt2)
  source 1..2077: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11882 - RNA, 2077 nt, synthetic construct
  misc_feature 1..2077: note = mRNA product Design d-4 comprising derived and/or modified sequence from HRSV(Memphis-37)__AIY60640.1__F0 (opt3)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11883 - RNA, 2077 nt, synthetic construct
  misc_feature 1..2077: note = mRNA product Design d-4 comprising derived and/or modified sequence from HRSV(Memphis-37)__AIY60640.1__F0 (opt4)
  source 1..2077: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11884 - RNA, 2077 nt, synthetic construct
  misc_feature 1..2077: note = mRNA product Design d-4 comprising derived and/or modified sequence from HRSV(Memphis-37)__AIY60640.1__F0 (opt5)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11885 - RNA, 2077 nt, synthetic construct
  misc_feature 1..2077: note = mRNA product Design d-4 comprising derived and/or modified sequence from HRSV(Memphis-37)__AIY60640.1__F0 (opt6)
  source 1..2077: mol_type = other RNA
gggagagtcccgcagtcggcgtccagcggctctgcttgttcgtgtgtgtgtcgttgcaggccttattcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11886 - RNA, 2077 nt, synthetic construct
  misc_feature 1..2077: note = mRNA product Design d-4 comprising derived and/or modified sequence from HRSV(Memphis-37)__AIY60640.1__F0 (opt11)
  source 1..2077: mol_type = other RNA
gggagagtcccgcagtcggcgtccagcggctctgcttgttcgtgtgtgtgtcgttgcaggccttattcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11887 - RNA, 2174 nt, synthetic construct
  misc_feature 1..2174: note = mRNA product Design d-5 comprising derived and/or modified sequence from HRSV(Memphis-37)__AIY60640.1__F0 (wt)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11888 - RNA, 2174 nt, synthetic construct
  misc_feature 1..2174: note = mRNA product Design d-5 comprising derived and/or modified sequence from HRSV(Memphis-37)__AIY60640.1__F0 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11889 - RNA, 2174 nt, synthetic construct
  misc_feature 1..2174: note = mRNA product Design d-5 comprising derived and/or modified sequence from HRSV(Memphis-37)__AIY60640.1__F0 (opt2)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11890 - RNA, 2174 nt, synthetic construct
  misc_feature 1..2174: note = mRNA product Design d-5 comprising derived and/or modified sequence from HRSV(Memphis-37)__AIY60640.1__F0 (opt3)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11891 - RNA, 2174 nt, synthetic construct
  misc_feature 1..2174: note = mRNA product Design d-5 comprising derived and/or modified sequence from HRSV(Memphis-37)__AIY60640.1__F0 (opt4)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11892 - RNA, 2174 nt, synthetic construct
  misc_feature 1..2174: note = mRNA product Design d-5 comprising derived and/or modified sequence from HRSV(Memphis-37)__AIY60640.1__F0 (opt5)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11893 - RNA, 2174 nt, synthetic construct
  misc_feature 1..2174: note = mRNA product Design d-5 comprising derived and/or modified sequence from HRSV(Memphis-37)__AIY60640.1__F0 (opt6)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11894 - RNA, 2174 nt, synthetic construct
  misc_feature 1..2174: note = mRNA product Design d-5 comprising derived and/or modified sequence from HRSV(Memphis-37)__AIY60640.1__F0 (opt11)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11895 - RNA, 2054 nt, synthetic construct
  misc_feature 1..2054: note = mRNA product Design e-1 comprising derived and/or modified sequence from HRSV(Memphis-37)__AIY60640.1__F0 (wt)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11896 - RNA, 2054 nt, synthetic construct
  misc_feature 1..2054: note = mRNA product Design e-1 comprising derived and/or modified sequence from HRSV(Memphis-37)__AIY60640.1__F0 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11897 - RNA, 2054 nt, synthetic construct
  misc_feature 1..2054: note = mRNA product Design e-1 comprising derived and/or modified sequence from HRSV(Memphis-37)__AIY60640.1__F0 (opt2)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11898 - RNA, 2054 nt, synthetic construct
  misc_feature 1..2054: note = mRNA product Design e-1 comprising derived and/or modified sequence from HRSV(Memphis-37)__AIY60640.1__F0 (opt3)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11899 - RNA, 2054 nt, synthetic construct
  misc_feature 1..2054: note = mRNA product Design e-1 comprising derived and/or modified sequence from HRSV(Memphis-37)__AIY60640.1__F0 (opt4)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11900 - RNA, 2054 nt, synthetic construct
  misc_feature 1..2054: note = mRNA product Design e-1 comprising derived and/or modified sequence from HRSV(Memphis-37)__AIY60640.1__F0 (opt5)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11901 - RNA, 2054 nt, synthetic construct
  misc_feature 1..2054: note = mRNA product Design e-1 comprising derived and/or modified sequence from HRSV(Memphis-37)__AIY60640.1__F0 (opt6)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11902 - RNA, 2054 nt, synthetic construct
  misc_feature 1..2054: note = mRNA product Design e-1 comprising derived and/or modified sequence from HRSV(Memphis-37)__AIY60640.1__F0 (opt11)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11903 - RNA, 2036 nt, synthetic construct
  misc_feature 1..2036: note = mRNA product Design e-2 comprising derived and/or modified sequence from HRSV(Memphis-37)__AIY60640.1__F0 (wt)
  source 1..2036: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11904 - RNA, 2036 nt, synthetic construct
  misc_feature 1..2036: note = mRNA product Design e-2 comprising derived and/or modified sequence from HRSV(Memphis-37)__AIY60640.1__F0 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11905 - RNA, 2036 nt, synthetic construct
  misc_feature 1..2036: note = mRNA product Design e-2 comprising derived and/or modified sequence from HRSV(Memphis-37)__AIY60640.1__F0 (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11906 - RNA, 2036 nt, synthetic construct
  misc_feature 1..2036: note = mRNA product Design e-2 comprising derived and/or modified sequence from HRSV(Memphis-37)__AIY60640.1__F0 (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11907 - RNA, 2036 nt, synthetic construct
  misc_feature 1..2036: note = mRNA product Design e-2 comprising derived and/or modified sequence from HRSV(Memphis-37)__AIY60640.1__F0 (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11908 - RNA, 2036 nt, synthetic construct
  misc_feature 1..2036: note = mRNA product Design e-2 comprising derived and/or modified sequence from HRSV(Memphis-37)__AIY60640.1__F0 (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11909 - RNA, 2036 nt, synthetic construct
  misc_feature 1..2036: note = mRNA product Design e-2 comprising derived and/or modified sequence from HRSV(Memphis-37)__AIY60640.1__F0 (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11910 - RNA, 2036 nt, synthetic construct
  misc_feature 1..2036: note = mRNA product Design e-2 comprising derived and/or modified sequence from HRSV(Memphis-37)__AIY60640.1__F0 (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11911 - RNA, 2006 nt, synthetic construct
  misc_feature 1..2006: note = mRNA product Design e-3 comprising derived and/or modified sequence from HRSV(Memphis-37)__AIY60640.1__F0 (wt)
  source 1..2006: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11912 - RNA, 2006 nt, synthetic construct
  misc_feature 1..2006: note = mRNA product Design e-3 comprising derived and/or modified sequence from HRSV(Memphis-37)__AIY60640.1__F0 (opt1)
  source 1..2006: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11913 - RNA, 2006 nt, synthetic construct
  misc_feature 1..2006: note = mRNA product Design e-3 comprising derived and/or modified sequence from HRSV(Memphis-37)__AIY60640.1__F0 (opt2)
  source 1..2006: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11914 - RNA, 2006 nt, synthetic construct
  misc_feature 1..2006: note = mRNA product Design e-3 comprising derived and/or modified sequence from HRSV(Memphis-37)__AIY60640.1__F0 (opt3)
  source 1..2006: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11915 - RNA, 2006 nt, synthetic construct
  misc_feature 1..2006: note = mRNA product Design e-3 comprising derived and/or modified sequence from HRSV(Memphis-37)__AIY60640.1__F0 (opt4)
  source 1..2006: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11916 - RNA, 2006 nt, synthetic construct
  misc_feature 1..2006: note = mRNA product Design e-3 comprising derived and/or modified sequence from HRSV(Memphis-37)__AIY60640.1__F0 (opt5)
  source 1..2006: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11917 - RNA, 2006 nt, synthetic construct
  misc_feature 1..2006: note = mRNA product Design e-3 comprising derived and/or modified sequence from HRSV(Memphis-37)__AIY60640.1__F0 (opt6)
  source 1..2006: mol_type = other RNA
gggagactttcccattctgtagcagaatttggtgttgcctgtggtcttggtcccgcggagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11918 - RNA, 2006 nt, synthetic construct
  misc_feature 1..2006: note = mRNA product Design e-3 comprising derived and/or modified sequence from HRSV(Memphis-37)__AIY60640.1__F0 (opt11)
  source 1..2006: mol_type = other RNA
gggagactttcccattctgtagcagaatttggtgttgcctgtggtcttggtcccgcggagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11919 - RNA, 2060 nt, synthetic construct
  misc_feature 1..2060: note = mRNA product Design e-4 comprising derived and/or modified sequence from HRSV(Memphis-37)__AIY60640.1__F0 (wt)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11920 - RNA, 2060 nt, synthetic construct
  misc_feature 1..2060: note = mRNA product Design e-4 comprising derived and/or modified sequence from HRSV(Memphis-37)__AIY60640.1__F0 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11921 - RNA, 2060 nt, synthetic construct
  misc_feature 1..2060: note = mRNA product Design e-4 comprising derived and/or modified sequence from HRSV(Memphis-37)__AIY60640.1__F0 (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11922 - RNA, 2060 nt, synthetic construct
  misc_feature 1..2060: note = mRNA product Design e-4 comprising derived and/or modified sequence from HRSV(Memphis-37)__AIY60640.1__F0 (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11923 - RNA, 2060 nt, synthetic construct
  misc_feature 1..2060: note = mRNA product Design e-4 comprising derived and/or modified sequence from HRSV(Memphis-37)__AIY60640.1__F0 (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11924 - RNA, 2060 nt, synthetic construct
  misc_feature 1..2060: note = mRNA product Design e-4 comprising derived and/or modified sequence from HRSV(Memphis-37)__AIY60640.1__F0 (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11925 - RNA, 2060 nt, synthetic construct
  misc_feature 1..2060: note = mRNA product Design e-4 comprising derived and/or modified sequence from HRSV(Memphis-37)__AIY60640.1__F0 (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11926 - RNA, 2060 nt, synthetic construct
  misc_feature 1..2060: note = mRNA product Design e-4 comprising derived and/or modified sequence from HRSV(Memphis-37)__AIY60640.1__F0 (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11927 - RNA, 2027 nt, synthetic construct
  misc_feature 1..2027: note = mRNA product Design e-5 comprising derived and/or modified sequence from HRSV(Memphis-37)__AIY60640.1__F0 (wt)
  source 1..2027: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11928 - RNA, 2027 nt, synthetic construct
  misc_feature 1..2027: note = mRNA product Design e-5 comprising derived and/or modified sequence from HRSV(Memphis-37)__AIY60640.1__F0 (opt1)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11929 - RNA, 2027 nt, synthetic construct
  misc_feature 1..2027: note = mRNA product Design e-5 comprising derived and/or modified sequence from HRSV(Memphis-37)__AIY60640.1__F0 (opt2)
  source 1..2027: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11930 - RNA, 2027 nt, synthetic construct
  misc_feature 1..2027: note = mRNA product Design e-5 comprising derived and/or modified sequence from HRSV(Memphis-37)__AIY60640.1__F0 (opt3)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11931 - RNA, 2027 nt, synthetic construct
  misc_feature 1..2027: note = mRNA product Design e-5 comprising derived and/or modified sequence from HRSV(Memphis-37)__AIY60640.1__F0 (opt4)
  source 1..2027: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11932 - RNA, 2027 nt, synthetic construct
  misc_feature 1..2027: note = mRNA product Design e-5 comprising derived and/or modified sequence from HRSV(Memphis-37)__AIY60640.1__F0 (opt5)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11933 - RNA, 2027 nt, synthetic construct
  misc_feature 1..2027: note = mRNA product Design e-5 comprising derived and/or modified sequence from HRSV(Memphis-37)__AIY60640.1__F0 (opt6)
  source 1..2027: mol_type = other RNA
gggagagcggctcggccattttgtcccagtcagtccggaggctgcggctgcagaagtaccgcctgcggagtaactgcaaagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11934 - RNA, 2027 nt, synthetic construct
  misc_feature 1..2027: note = mRNA product Design e-5 comprising derived and/or modified sequence from HRSV(Memphis-37)__AIY60640.1__F0 (opt11)
  source 1..2027: mol_type = other RNA
gggagagcggctcggccattttgtcccagtcagtccggaggctgcggctgcagaagtaccgcctgcggagtaactgcaaagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11935 - RNA, 2094 nt, synthetic construct
  misc_feature 1..2094: note = mRNA product Design e-6 comprising derived and/or modified sequence from HRSV(Memphis-37)__AIY60640.1__F0 (wt)
  source 1..2094: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11936 - RNA, 2094 nt, synthetic construct
  misc_feature 1..2094: note = mRNA product Design e-6 comprising derived and/or modified sequence from HRSV(Memphis-37)__AIY60640.1__F0 (opt1)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11937 - RNA, 2094 nt, synthetic construct
  misc_feature 1..2094: note = mRNA product Design e-6 comprising derived and/or modified sequence from HRSV(Memphis-37)__AIY60640.1__F0 (opt2)
  source 1..2094: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11938 - RNA, 2094 nt, synthetic construct
  misc_feature 1..2094: note = mRNA product Design e-6 comprising derived and/or modified sequence from HRSV(Memphis-37)__AIY60640.1__F0 (opt3)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11939 - RNA, 2094 nt, synthetic construct
  misc_feature 1..2094: note = mRNA product Design e-6 comprising derived and/or modified sequence from HRSV(Memphis-37)__AIY60640.1__F0 (opt4)
  source 1..2094: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11940 - RNA, 2094 nt, synthetic construct
  misc_feature 1..2094: note = mRNA product Design e-6 comprising derived and/or modified sequence from HRSV(Memphis-37)__AIY60640.1__F0 (opt5)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11941 - RNA, 2094 nt, synthetic construct
  misc_feature 1..2094: note = mRNA product Design e-6 comprising derived and/or modified sequence from HRSV(Memphis-37)__AIY60640.1__F0 (opt6)
  source 1..2094: mol_type = other RNA
gggagagcggctcggccattttgtcccagtcagtccggaggctgcggctgcagaagtaccgcctgcggagtaactgcaaagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11942 - RNA, 2094 nt, synthetic construct
  misc_feature 1..2094: note = mRNA product Design e-6 comprising derived and/or modified sequence from HRSV(Memphis-37)__AIY60640.1__F0 (opt11)
  source 1..2094: mol_type = other RNA
gggagagcggctcggccattttgtcccagtcagtccggaggctgcggctgcagaagtaccgcctgcggagtaactgcaaagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11943 - RNA, 2310 nt, synthetic construct
  misc_feature 1..2310: note = mRNA product Design f-1 comprising derived and/or modified sequence from HRSV(Memphis-37)__AIY60640.1__F0 (wt)
  source 1..2310: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11944 - RNA, 2310 nt, synthetic construct
  misc_feature 1..2310: note = mRNA product Design f-1 comprising derived and/or modified sequence from HRSV(Memphis-37)__AIY60640.1__F0 (opt1)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11945 - RNA, 2310 nt, synthetic construct
  misc_feature 1..2310: note = mRNA product Design f-1 comprising derived and/or modified sequence from HRSV(Memphis-37)__AIY60640.1__F0 (opt2)
  source 1..2310: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11946 - RNA, 2310 nt, synthetic construct
  misc_feature 1..2310: note = mRNA product Design f-1 comprising derived and/or modified sequence from HRSV(Memphis-37)__AIY60640.1__F0 (opt3)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11947 - RNA, 2310 nt, synthetic construct
  misc_feature 1..2310: note = mRNA product Design f-1 comprising derived and/or modified sequence from HRSV(Memphis-37)__AIY60640.1__F0 (opt4)
  source 1..2310: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11948 - RNA, 2310 nt, synthetic construct
  misc_feature 1..2310: note = mRNA product Design f-1 comprising derived and/or modified sequence from HRSV(Memphis-37)__AIY60640.1__F0 (opt5)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11949 - RNA, 2310 nt, synthetic construct
  misc_feature 1..2310: note = mRNA product Design f-1 comprising derived and/or modified sequence from HRSV(Memphis-37)__AIY60640.1__F0 (opt6)
  source 1..2310: mol_type = other RNA
gggagagcggctcggccattttgtcccagtcagtccggaggctgcggctgcagaagtaccgcctgcggagtaactgcaaagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11950 - RNA, 2310 nt, synthetic construct
  misc_feature 1..2310: note = mRNA product Design f-1 comprising derived and/or modified sequence from HRSV(Memphis-37)__AIY60640.1__F0 (opt11)
  source 1..2310: mol_type = other RNA
gggagagcggctcggccattttgtcccagtcagtccggaggctgcggctgcagaagtaccgcctgcggagtaactgcaaagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11951 - RNA, 2090 nt, synthetic construct
  misc_feature 1..2090: note = mRNA product Design f-2 comprising derived and/or modified sequence from HRSV(Memphis-37)__AIY60640.1__F0 (wt)
  source 1..2090: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11952 - RNA, 2090 nt, synthetic construct
  misc_feature 1..2090: note = mRNA product Design f-2 comprising derived and/or modified sequence from HRSV(Memphis-37)__AIY60640.1__F0 (opt1)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11953 - RNA, 2090 nt, synthetic construct
  misc_feature 1..2090: note = mRNA product Design f-2 comprising derived and/or modified sequence from HRSV(Memphis-37)__AIY60640.1__F0 (opt2)
  source 1..2090: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11954 - RNA, 2090 nt, synthetic construct
  misc_feature 1..2090: note = mRNA product Design f-2 comprising derived and/or modified sequence from HRSV(Memphis-37)__AIY60640.1__F0 (opt3)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11955 - RNA, 2090 nt, synthetic construct
  misc_feature 1..2090: note = mRNA product Design f-2 comprising derived and/or modified sequence from HRSV(Memphis-37)__AIY60640.1__F0 (opt4)
  source 1..2090: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11956 - RNA, 2090 nt, synthetic construct
  misc_feature 1..2090: note = mRNA product Design f-2 comprising derived and/or modified sequence from HRSV(Memphis-37)__AIY60640.1__F0 (opt5)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11957 - RNA, 2090 nt, synthetic construct
  misc_feature 1..2090: note = mRNA product Design f-2 comprising derived and/or modified sequence from HRSV(Memphis-37)__AIY60640.1__F0 (opt6)
  source 1..2090: mol_type = other RNA
gggagagcggctcggccattttgtcccagtcagtccggaggctgcggctgcagaagtaccgcctgcggagtaactgcaaagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11958 - RNA, 2090 nt, synthetic construct
  misc_feature 1..2090: note = mRNA product Design f-2 comprising derived and/or modified sequence from HRSV(Memphis-37)__AIY60640.1__F0 (opt11)
  source 1..2090: mol_type = other RNA
gggagagcggctcggccattttgtcccagtcagtccggaggctgcggctgcagaagtaccgcctgcggagtaactgcaaagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11959 - RNA, 2081 nt, synthetic construct
  misc_feature 1..2081: note = mRNA product Design f-3 comprising derived and/or modified sequence from HRSV(Memphis-37)__AIY60640.1__F0 (wt)
  source 1..2081: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11960 - RNA, 2081 nt, synthetic construct
  misc_feature 1..2081: note = mRNA product Design f-3 comprising derived and/or modified sequence from HRSV(Memphis-37)__AIY60640.1__F0 (opt1)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11961 - RNA, 2081 nt, synthetic construct
  misc_feature 1..2081: note = mRNA product Design f-3 comprising derived and/or modified sequence from HRSV(Memphis-37)__AIY60640.1__F0 (opt2)
  source 1..2081: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11962 - RNA, 2081 nt, synthetic construct
  misc_feature 1..2081: note = mRNA product Design f-3 comprising derived and/or modified sequence from HRSV(Memphis-37)__AIY60640.1__F0 (opt3)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11963 - RNA, 2081 nt, synthetic construct
  misc_feature 1..2081: note = mRNA product Design f-3 comprising derived and/or modified sequence from HRSV(Memphis-37)__AIY60640.1__F0 (opt4)
  source 1..2081: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11964 - RNA, 2081 nt, synthetic construct
  misc_feature 1..2081: note = mRNA product Design f-3 comprising derived and/or modified sequence from HRSV(Memphis-37)__AIY60640.1__F0 (opt5)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11965 - RNA, 2081 nt, synthetic construct
  misc_feature 1..2081: note = mRNA product Design f-3 comprising derived and/or modified sequence from HRSV(Memphis-37)__AIY60640.1__F0 (opt6)
  source 1..2081: mol_type = other RNA
gggagagtcccgcagtcggcgtccagcggctctgcttgttcgtgtgtgtgtcgttgcaggccttattcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11966 - RNA, 2081 nt, synthetic construct
  misc_feature 1..2081: note = mRNA product Design f-3 comprising derived and/or modified sequence from HRSV(Memphis-37)__AIY60640.1__F0 (opt11)
  source 1..2081: mol_type = other RNA
gggagagtcccgcagtcggcgtccagcggctctgcttgttcgtgtgtgtgtcgttgcaggccttattcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11967 - RNA, 2297 nt, synthetic construct
  misc_feature 1..2297: note = mRNA product Design f-4 comprising derived and/or modified sequence from HRSV(Memphis-37)__AIY60640.1__F0 (wt)
  source 1..2297: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11968 - RNA, 2297 nt, synthetic construct
  misc_feature 1..2297: note = mRNA product Design f-4 comprising derived and/or modified sequence from HRSV(Memphis-37)__AIY60640.1__F0 (opt1)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11969 - RNA, 2297 nt, synthetic construct
  misc_feature 1..2297: note = mRNA product Design f-4 comprising derived and/or modified sequence from HRSV(Memphis-37)__AIY60640.1__F0 (opt2)
  source 1..2297: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11970 - RNA, 2297 nt, synthetic construct
  misc_feature 1..2297: note = mRNA product Design f-4 comprising derived and/or modified sequence from HRSV(Memphis-37)__AIY60640.1__F0 (opt3)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11971 - RNA, 2297 nt, synthetic construct
  misc_feature 1..2297: note = mRNA product Design f-4 comprising derived and/or modified sequence from HRSV(Memphis-37)__AIY60640.1__F0 (opt4)
  source 1..2297: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11972 - RNA, 2297 nt, synthetic construct
  misc_feature 1..2297: note = mRNA product Design f-4 comprising derived and/or modified sequence from HRSV(Memphis-37)__AIY60640.1__F0 (opt5)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11973 - RNA, 2297 nt, synthetic construct
  misc_feature 1..2297: note = mRNA product Design f-4 comprising derived and/or modified sequence from HRSV(Memphis-37)__AIY60640.1__F0 (opt6)
  source 1..2297: mol_type = other RNA
gggagagtcccgcagtcggcgtccagcggctctgcttgttcgtgtgtgtgtcgttgcaggccttattcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11974 - RNA, 2297 nt, synthetic construct
  misc_feature 1..2297: note = mRNA product Design f-4 comprising derived and/or modified sequence from HRSV(Memphis-37)__AIY60640.1__F0 (opt11)
  source 1..2297: mol_type = other RNA
gggagagtcccgcagtcggcgtccagcggctctgcttgttcgtgtgtgtgtcgttgcaggccttattcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11975 - RNA, 2073 nt, synthetic construct
  misc_feature 1..2073: note = mRNA product Design f-5 comprising derived and/or modified sequence from HRSV(Memphis-37)__AIY60640.1__F0 (wt)
  source 1..2073: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11976 - RNA, 2073 nt, synthetic construct
  misc_feature 1..2073: note = mRNA product Design f-5 comprising derived and/or modified sequence from HRSV(Memphis-37)__AIY60640.1__F0 (opt1)
  source 1..2073: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11977 - RNA, 2073 nt, synthetic construct
  misc_feature 1..2073: note = mRNA product Design f-5 comprising derived and/or modified sequence from HRSV(Memphis-37)__AIY60640.1__F0 (opt2)
  source 1..2073: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11978 - RNA, 2073 nt, synthetic construct
  misc_feature 1..2073: note = mRNA product Design f-5 comprising derived and/or modified sequence from HRSV(Memphis-37)__AIY60640.1__F0 (opt3)
  source 1..2073: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11979 - RNA, 2073 nt, synthetic construct
  misc_feature 1..2073: note = mRNA product Design f-5 comprising derived and/or modified sequence from HRSV(Memphis-37)__AIY60640.1__F0 (opt4)
  source 1..2073: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11980 - RNA, 2073 nt, synthetic construct
  misc_feature 1..2073: note = mRNA product Design f-5 comprising derived and/or modified sequence from HRSV(Memphis-37)__AIY60640.1__F0 (opt5)
  source 1..2073: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11981 - RNA, 2073 nt, synthetic construct
  misc_feature 1..2073: note = mRNA product Design f-5 comprising derived and/or modified sequence from HRSV(Memphis-37)__AIY60640.1__F0 (opt6)
  source 1..2073: mol_type = other RNA
gggagactttcccattctgtagcagaatttggtgttgcctgtggtcttggtcccgcggagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11982 - RNA, 2073 nt, synthetic construct
  misc_feature 1..2073: note = mRNA product Design f-5 comprising derived and/or modified sequence from HRSV(Memphis-37)__AIY60640.1__F0 (opt11)
  source 1..2073: mol_type = other RNA
gggagactttcccattctgtagcagaatttggtgttgcctgtggtcttggtcccgcggagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11983 - RNA, 2069 nt, synthetic construct
  misc_feature 1..2069: note = mRNA product Design g-1 comprising derived and/or modified sequence from HRSV(Memphis-37)__AIY60640.1__F0 (wt)
  source 1..2069: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11984 - RNA, 2069 nt, synthetic construct
  misc_feature 1..2069: note = mRNA product Design g-1 comprising derived and/or modified sequence from HRSV(Memphis-37)__AIY60640.1__F0 (opt1)
  source 1..2069: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11985 - RNA, 2069 nt, synthetic construct
  misc_feature 1..2069: note = mRNA product Design g-1 comprising derived and/or modified sequence from HRSV(Memphis-37)__AIY60640.1__F0 (opt2)
  source 1..2069: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11986 - RNA, 2069 nt, synthetic construct
  misc_feature 1..2069: note = mRNA product Design g-1 comprising derived and/or modified sequence from HRSV(Memphis-37)__AIY60640.1__F0 (opt3)
  source 1..2069: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11987 - RNA, 2069 nt, synthetic construct
  misc_feature 1..2069: note = mRNA product Design g-1 comprising derived and/or modified sequence from HRSV(Memphis-37)__AIY60640.1__F0 (opt4)
  source 1..2069: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11988 - RNA, 2069 nt, synthetic construct
  misc_feature 1..2069: note = mRNA product Design g-1 comprising derived and/or modified sequence from HRSV(Memphis-37)__AIY60640.1__F0 (opt5)
  source 1..2069: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11989 - RNA, 2069 nt, synthetic construct
  misc_feature 1..2069: note = mRNA product Design g-1 comprising derived and/or modified sequence from HRSV(Memphis-37)__AIY60640.1__F0 (opt6)
  source 1..2069: mol_type = other RNA
gggagactttcccattctgtagcagaatttggtgttgcctgtggtcttggtcccgcggagaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11990 - RNA, 2069 nt, synthetic construct
  misc_feature 1..2069: note = mRNA product Design g-1 comprising derived and/or modified sequence from HRSV(Memphis-37)__AIY60640.1__F0 (opt11)
  source 1..2069: mol_type = other RNA
gggagactttcccattctgtagcagaatttggtgttgcctgtggtcttggtcccgcggagaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11991 - RNA, 2084 nt, synthetic construct
  misc_feature 1..2084: note = mRNA product Design g-2 comprising derived and/or modified sequence from HRSV(Memphis-37)__AIY60640.1__F0 (wt)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11992 - RNA, 2084 nt, synthetic construct
  misc_feature 1..2084: note = mRNA product Design g-2 comprising derived and/or modified sequence from HRSV(Memphis-37)__AIY60640.1__F0 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11993 - RNA, 2084 nt, synthetic construct
  misc_feature 1..2084: note = mRNA product Design g-2 comprising derived and/or modified sequence from HRSV(Memphis-37)__AIY60640.1__F0 (opt2)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11994 - RNA, 2084 nt, synthetic construct
  misc_feature 1..2084: note = mRNA product Design g-2 comprising derived and/or modified sequence from HRSV(Memphis-37)__AIY60640.1__F0 (opt3)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11995 - RNA, 2084 nt, synthetic construct
  misc_feature 1..2084: note = mRNA product Design g-2 comprising derived and/or modified sequence from HRSV(Memphis-37)__AIY60640.1__F0 (opt4)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11996 - RNA, 2084 nt, synthetic construct
  misc_feature 1..2084: note = mRNA product Design g-2 comprising derived and/or modified sequence from HRSV(Memphis-37)__AIY60640.1__F0 (opt5)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11997 - RNA, 2084 nt, synthetic construct
  misc_feature 1..2084: note = mRNA product Design g-2 comprising derived and/or modified sequence from HRSV(Memphis-37)__AIY60640.1__F0 (opt6)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11998 - RNA, 2084 nt, synthetic construct
  misc_feature 1..2084: note = mRNA product Design g-2 comprising derived and/or modified sequence from HRSV(Memphis-37)__AIY60640.1__F0 (opt11)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 11999 - RNA, 2316 nt, synthetic construct
  misc_feature 1..2316: note = mRNA product Design g-3 comprising derived and/or modified sequence from HRSV(Memphis-37)__AIY60640.1__F0 (wt)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12000 - RNA, 2316 nt, synthetic construct
  misc_feature 1..2316: note = mRNA product Design g-3 comprising derived and/or modified sequence from HRSV(Memphis-37)__AIY60640.1__F0 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12001 - RNA, 2316 nt, synthetic construct
  misc_feature 1..2316: note = mRNA product Design g-3 comprising derived and/or modified sequence from HRSV(Memphis-37)__AIY60640.1__F0 (opt2)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12002 - RNA, 2316 nt, synthetic construct
  misc_feature 1..2316: note = mRNA product Design g-3 comprising derived and/or modified sequence from HRSV(Memphis-37)__AIY60640.1__F0 (opt3)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12003 - RNA, 2316 nt, synthetic construct
  misc_feature 1..2316: note = mRNA product Design g-3 comprising derived and/or modified sequence from HRSV(Memphis-37)__AIY60640.1__F0 (opt4)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12004 - RNA, 2316 nt, synthetic construct
  misc_feature 1..2316: note = mRNA product Design g-3 comprising derived and/or modified sequence from HRSV(Memphis-37)__AIY60640.1__F0 (opt5)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12005 - RNA, 2316 nt, synthetic construct
  misc_feature 1..2316: note = mRNA product Design g-3 comprising derived and/or modified sequence from HRSV(Memphis-37)__AIY60640.1__F0 (opt6)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12006 - RNA, 2316 nt, synthetic construct
  misc_feature 1..2316: note = mRNA product Design g-3 comprising derived and/or modified sequence from HRSV(Memphis-37)__AIY60640.1__F0 (opt11)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12007 - RNA, 2111 nt, synthetic construct
  misc_feature 1..2111: note = mRNA product Design g-4 comprising derived and/or modified sequence from HRSV(Memphis-37)__AIY60640.1__F0 (wt)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12008 - RNA, 2111 nt, synthetic construct
  misc_feature 1..2111: note = mRNA product Design g-4 comprising derived and/or modified sequence from HRSV(Memphis-37)__AIY60640.1__F0 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12009 - RNA, 2111 nt, synthetic construct
  misc_feature 1..2111: note = mRNA product Design g-4 comprising derived and/or modified sequence from HRSV(Memphis-37)__AIY60640.1__F0 (opt2)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12010 - RNA, 2111 nt, synthetic construct
  misc_feature 1..2111: note = mRNA product Design g-4 comprising derived and/or modified sequence from HRSV(Memphis-37)__AIY60640.1__F0 (opt3)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12011 - RNA, 2111 nt, synthetic construct
  misc_feature 1..2111: note = mRNA product Design g-4 comprising derived and/or modified sequence from HRSV(Memphis-37)__AIY60640.1__F0 (opt4)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12012 - RNA, 2111 nt, synthetic construct
  misc_feature 1..2111: note = mRNA product Design g-4 comprising derived and/or modified sequence from HRSV(Memphis-37)__AIY60640.1__F0 (opt5)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12013 - RNA, 2111 nt, synthetic construct
  misc_feature 1..2111: note = mRNA product Design g-4 comprising derived and/or modified sequence from HRSV(Memphis-37)__AIY60640.1__F0 (opt6)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12014 - RNA, 2111 nt, synthetic construct
  misc_feature 1..2111: note = mRNA product Design g-4 comprising derived and/or modified sequence from HRSV(Memphis-37)__AIY60640.1__F0 (opt11)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12015 - RNA, 2087 nt, synthetic construct
  misc_feature 1..2087: note = mRNA product Design g-5 comprising derived and/or modified sequence from HRSV(Memphis-37)__AIY60640.1__F0 (wt)
  source 1..2087: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12016 - RNA, 2087 nt, synthetic construct
  misc_feature 1..2087: note = mRNA product Design g-5 comprising derived and/or modified sequence from HRSV(Memphis-37)__AIY60640.1__F0 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12017 - RNA, 2087 nt, synthetic construct
  misc_feature 1..2087: note = mRNA product Design g-5 comprising derived and/or modified sequence from HRSV(Memphis-37)__AIY60640.1__F0 (opt2)
  source 1..2087: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12018 - RNA, 2087 nt, synthetic construct
  misc_feature 1..2087: note = mRNA product Design g-5 comprising derived and/or modified sequence from HRSV(Memphis-37)__AIY60640.1__F0 (opt3)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12019 - RNA, 2087 nt, synthetic construct
  misc_feature 1..2087: note = mRNA product Design g-5 comprising derived and/or modified sequence from HRSV(Memphis-37)__AIY60640.1__F0 (opt4)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12020 - RNA, 2087 nt, synthetic construct
  misc_feature 1..2087: note = mRNA product Design g-5 comprising derived and/or modified sequence from HRSV(Memphis-37)__AIY60640.1__F0 (opt5)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12021 - RNA, 2087 nt, synthetic construct
  misc_feature 1..2087: note = mRNA product Design g-5 comprising derived and/or modified sequence from HRSV(Memphis-37)__AIY60640.1__F0 (opt6)
  source 1..2087: mol_type = other RNA
gggagacccgtgacccggaagttgtacggctacgcgactttccctcccacaaaccctcgcgcccttcctttcctacttgggcccggcagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12022 - RNA, 2087 nt, synthetic construct
  misc_feature 1..2087: note = mRNA product Design g-5 comprising derived and/or modified sequence from HRSV(Memphis-37)__AIY60640.1__F0 (opt11)
  source 1..2087: mol_type = other RNA
gggagacccgtgacccggaagttgtacggctacgcgactttccctcccacaaaccctcgcgcccttcctttcctacttgggcccggcagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12023 - RNA, 2103 nt, synthetic construct
  misc_feature 1..2103: note = mRNA product Design h-1 comprising derived and/or modified sequence from HRSV(Memphis-37)__AIY60640.1__F0 (wt)
  source 1..2103: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12024 - RNA, 2103 nt, synthetic construct
  misc_feature 1..2103: note = mRNA product Design h-1 comprising derived and/or modified sequence from HRSV(Memphis-37)__AIY60640.1__F0 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12025 - RNA, 2103 nt, synthetic construct
  misc_feature 1..2103: note = mRNA product Design h-1 comprising derived and/or modified sequence from HRSV(Memphis-37)__AIY60640.1__F0 (opt2)
  source 1..2103: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12026 - RNA, 2103 nt, synthetic construct
  misc_feature 1..2103: note = mRNA product Design h-1 comprising derived and/or modified sequence from HRSV(Memphis-37)__AIY60640.1__F0 (opt3)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12027 - RNA, 2103 nt, synthetic construct
  misc_feature 1..2103: note = mRNA product Design h-1 comprising derived and/or modified sequence from HRSV(Memphis-37)__AIY60640.1__F0 (opt4)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12028 - RNA, 2103 nt, synthetic construct
  misc_feature 1..2103: note = mRNA product Design h-1 comprising derived and/or modified sequence from HRSV(Memphis-37)__AIY60640.1__F0 (opt5)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12029 - RNA, 2103 nt, synthetic construct
  misc_feature 1..2103: note = mRNA product Design h-1 comprising derived and/or modified sequence from HRSV(Memphis-37)__AIY60640.1__F0 (opt6)
  source 1..2103: mol_type = other RNA
gggagacccgtgacccggaagttgtacggctacgcgactttccctcccacaaaccctcgcgcccttcctttcctacttgggcccggcagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12030 - RNA, 2103 nt, synthetic construct
  misc_feature 1..2103: note = mRNA product Design h-1 comprising derived and/or modified sequence from HRSV(Memphis-37)__AIY60640.1__F0 (opt11)
  source 1..2103: mol_type = other RNA
gggagacccgtgacccggaagttgtacggctacgcgactttccctcccacaaaccctcgcgcccttcctttcctacttgggcccggcagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12031 - RNA, 2319 nt, synthetic construct
  misc_feature 1..2319: note = mRNA product Design h-2 comprising derived and/or modified sequence from HRSV(Memphis-37)__AIY60640.1__F0 (wt)
  source 1..2319: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12032 - RNA, 2319 nt, synthetic construct
  misc_feature 1..2319: note = mRNA product Design h-2 comprising derived and/or modified sequence from HRSV(Memphis-37)__AIY60640.1__F0 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12033 - RNA, 2319 nt, synthetic construct
  misc_feature 1..2319: note = mRNA product Design h-2 comprising derived and/or modified sequence from HRSV(Memphis-37)__AIY60640.1__F0 (opt2)
  source 1..2319: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12034 - RNA, 2319 nt, synthetic construct
  misc_feature 1..2319: note = mRNA product Design h-2 comprising derived and/or modified sequence from HRSV(Memphis-37)__AIY60640.1__F0 (opt3)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12035 - RNA, 2319 nt, synthetic construct
  misc_feature 1..2319: note = mRNA product Design h-2 comprising derived and/or modified sequence from HRSV(Memphis-37)__AIY60640.1__F0 (opt4)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12036 - RNA, 2319 nt, synthetic construct
  misc_feature 1..2319: note = mRNA product Design h-2 comprising derived and/or modified sequence from HRSV(Memphis-37)__AIY60640.1__F0 (opt5)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12037 - RNA, 2319 nt, synthetic construct
  misc_feature 1..2319: note = mRNA product Design h-2 comprising derived and/or modified sequence from HRSV(Memphis-37)__AIY60640.1__F0 (opt6)
  source 1..2319: mol_type = other RNA
gggagacccgtgacccggaagttgtacggctacgcgactttccctcccacaaaccctcgcgcccttcctttcctacttgggcccggcagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12038 - RNA, 2319 nt, synthetic construct
  misc_feature 1..2319: note = mRNA product Design h-2 comprising derived and/or modified sequence from HRSV(Memphis-37)__AIY60640.1__F0 (opt11)
  source 1..2319: mol_type = other RNA
gggagacccgtgacccggaagttgtacggctacgcgactttccctcccacaaaccctcgcgcccttcctttcctacttgggcccggcagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12039 - RNA, 2099 nt, synthetic construct
  misc_feature 1..2099: note = mRNA product Design h-3 comprising derived and/or modified sequence from HRSV(Memphis-37)__AIY60640.1__F0 (wt)
  source 1..2099: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12040 - RNA, 2099 nt, synthetic construct
  misc_feature 1..2099: note = mRNA product Design h-3 comprising derived and/or modified sequence from HRSV(Memphis-37)__AIY60640.1__F0 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12041 - RNA, 2099 nt, synthetic construct
  misc_feature 1..2099: note = mRNA product Design h-3 comprising derived and/or modified sequence from HRSV(Memphis-37)__AIY60640.1__F0 (opt2)
  source 1..2099: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12042 - RNA, 2099 nt, synthetic construct
  misc_feature 1..2099: note = mRNA product Design h-3 comprising derived and/or modified sequence from HRSV(Memphis-37)__AIY60640.1__F0 (opt3)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12043 - RNA, 2099 nt, synthetic construct
  misc_feature 1..2099: note = mRNA product Design h-3 comprising derived and/or modified sequence from HRSV(Memphis-37)__AIY60640.1__F0 (opt4)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12044 - RNA, 2099 nt, synthetic construct
  misc_feature 1..2099: note = mRNA product Design h-3 comprising derived and/or modified sequence from HRSV(Memphis-37)__AIY60640.1__F0 (opt5)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12045 - RNA, 2099 nt, synthetic construct
  misc_feature 1..2099: note = mRNA product Design h-3 comprising derived and/or modified sequence from HRSV(Memphis-37)__AIY60640.1__F0 (opt6)
  source 1..2099: mol_type = other RNA
gggagacccgtgacccggaagttgtacggctacgcgactttccctcccacaaaccctcgcgcccttcctttcctacttgggcccggcagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12046 - RNA, 2099 nt, synthetic construct
  misc_feature 1..2099: note = mRNA product Design h-3 comprising derived and/or modified sequence from HRSV(Memphis-37)__AIY60640.1__F0 (opt11)
  source 1..2099: mol_type = other RNA
gggagacccgtgacccggaagttgtacggctacgcgactttccctcccacaaaccctcgcgcccttcctttcctacttgggcccggcagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12047 - RNA, 2162 nt, synthetic construct
  misc_feature 1..2162: note = mRNA product Design h-4 comprising derived and/or modified sequence from HRSV(Memphis-37)__AIY60640.1__F0 (wt)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12048 - RNA, 2162 nt, synthetic construct
  misc_feature 1..2162: note = mRNA product Design h-4 comprising derived and/or modified sequence from HRSV(Memphis-37)__AIY60640.1__F0 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12049 - RNA, 2162 nt, synthetic construct
  misc_feature 1..2162: note = mRNA product Design h-4 comprising derived and/or modified sequence from HRSV(Memphis-37)__AIY60640.1__F0 (opt2)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12050 - RNA, 2162 nt, synthetic construct
  misc_feature 1..2162: note = mRNA product Design h-4 comprising derived and/or modified sequence from HRSV(Memphis-37)__AIY60640.1__F0 (opt3)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12051 - RNA, 2162 nt, synthetic construct
  misc_feature 1..2162: note = mRNA product Design h-4 comprising derived and/or modified sequence from HRSV(Memphis-37)__AIY60640.1__F0 (opt4)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12052 - RNA, 2162 nt, synthetic construct
  misc_feature 1..2162: note = mRNA product Design h-4 comprising derived and/or modified sequence from HRSV(Memphis-37)__AIY60640.1__F0 (opt5)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12053 - RNA, 2162 nt, synthetic construct
  misc_feature 1..2162: note = mRNA product Design h-4 comprising derived and/or modified sequence from HRSV(Memphis-37)__AIY60640.1__F0 (opt6)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12054 - RNA, 2162 nt, synthetic construct
  misc_feature 1..2162: note = mRNA product Design h-4 comprising derived and/or modified sequence from HRSV(Memphis-37)__AIY60640.1__F0 (opt11)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12055 - RNA, 2178 nt, synthetic construct
  misc_feature 1..2178: note = mRNA product Design h-5 comprising derived and/or modified sequence from HRSV(Memphis-37)__AIY60640.1__F0 (wt)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12056 - RNA, 2178 nt, synthetic construct
  misc_feature 1..2178: note = mRNA product Design h-5 comprising derived and/or modified sequence from HRSV(Memphis-37)__AIY60640.1__F0 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12057 - RNA, 2178 nt, synthetic construct
  misc_feature 1..2178: note = mRNA product Design h-5 comprising derived and/or modified sequence from HRSV(Memphis-37)__AIY60640.1__F0 (opt2)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12058 - RNA, 2178 nt, synthetic construct
  misc_feature 1..2178: note = mRNA product Design h-5 comprising derived and/or modified sequence from HRSV(Memphis-37)__AIY60640.1__F0 (opt3)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12059 - RNA, 2178 nt, synthetic construct
  misc_feature 1..2178: note = mRNA product Design h-5 comprising derived and/or modified sequence from HRSV(Memphis-37)__AIY60640.1__F0 (opt4)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12060 - RNA, 2178 nt, synthetic construct
  misc_feature 1..2178: note = mRNA product Design h-5 comprising derived and/or modified sequence from HRSV(Memphis-37)__AIY60640.1__F0 (opt5)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12061 - RNA, 2178 nt, synthetic construct
  misc_feature 1..2178: note = mRNA product Design h-5 comprising derived and/or modified sequence from HRSV(Memphis-37)__AIY60640.1__F0 (opt6)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12062 - RNA, 2178 nt, synthetic construct
  misc_feature 1..2178: note = mRNA product Design h-5 comprising derived and/or modified sequence from HRSV(Memphis-37)__AIY60640.1__F0 (opt11)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12063 - RNA, 2111 nt, synthetic construct
  misc_feature 1..2111: note = mRNA product Design i-1 comprising derived and/or modified sequence from HRSV(Memphis-37)__AIY60640.1__F0 (wt)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12064 - RNA, 2111 nt, synthetic construct
  misc_feature 1..2111: note = mRNA product Design i-1 comprising derived and/or modified sequence from HRSV(Memphis-37)__AIY60640.1__F0 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12065 - RNA, 2111 nt, synthetic construct
  misc_feature 1..2111: note = mRNA product Design i-1 comprising derived and/or modified sequence from HRSV(Memphis-37)__AIY60640.1__F0 (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12066 - RNA, 2111 nt, synthetic construct
  misc_feature 1..2111: note = mRNA product Design i-1 comprising derived and/or modified sequence from HRSV(Memphis-37)__AIY60640.1__F0 (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12067 - RNA, 2111 nt, synthetic construct
  misc_feature 1..2111: note = mRNA product Design i-1 comprising derived and/or modified sequence from HRSV(Memphis-37)__AIY60640.1__F0 (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12068 - RNA, 2111 nt, synthetic construct
  misc_feature 1..2111: note = mRNA product Design i-1 comprising derived and/or modified sequence from HRSV(Memphis-37)__AIY60640.1__F0 (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12069 - RNA, 2111 nt, synthetic construct
  misc_feature 1..2111: note = mRNA product Design i-1 comprising derived and/or modified sequence from HRSV(Memphis-37)__AIY60640.1__F0 (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12070 - RNA, 2111 nt, synthetic construct
  misc_feature 1..2111: note = mRNA product Design i-1 comprising derived and/or modified sequence from HRSV(Memphis-37)__AIY60640.1__F0 (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12071 - RNA, 2111 nt, synthetic construct
  misc_feature 1..2111: note = mRNA product Design i-2 comprising derived and/or modified sequence from HRSV(Memphis-37)__AIY60640.1__F0 (wt)
  source 1..2111: mol_type = other RNA
gggagaggcgctgcctacggaggtggcagccatctccttctcggcatcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12072 - RNA, 2111 nt, synthetic construct
  misc_feature 1..2111: note = mRNA product Design i-2 comprising derived and/or modified sequence from HRSV(Memphis-37)__AIY60640.1__F0 (opt1)
  source 1..2111: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12073 - RNA, 2111 nt, synthetic construct
  misc_feature 1..2111: note = mRNA product Design i-2 comprising derived and/or modified sequence from HRSV(Memphis-37)__AIY60640.1__F0 (opt2)
  source 1..2111: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12074 - RNA, 2111 nt, synthetic construct
  misc_feature 1..2111: note = mRNA product Design i-2 comprising derived and/or modified sequence from HRSV(Memphis-37)__AIY60640.1__F0 (opt3)
  source 1..2111: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12075 - RNA, 2111 nt, synthetic construct
  misc_feature 1..2111: note = mRNA product Design i-2 comprising derived and/or modified sequence from HRSV(Memphis-37)__AIY60640.1__F0 (opt4)
  source 1..2111: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12076 - RNA, 2111 nt, synthetic construct
  misc_feature 1..2111: note = mRNA product Design i-2 comprising derived and/or modified sequence from HRSV(Memphis-37)__AIY60640.1__F0 (opt5)
  source 1..2111: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12077 - RNA, 2111 nt, synthetic construct
  misc_feature 1..2111: note = mRNA product Design i-2 comprising derived and/or modified sequence from HRSV(Memphis-37)__AIY60640.1__F0 (opt6)
  source 1..2111: mol_type = other RNA
gggagaggcgctgcctacggaggtggcagccatctccttctcggcatcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12078 - RNA, 2111 nt, synthetic construct
  misc_feature 1..2111: note = mRNA product Design i-2 comprising derived and/or modified sequence from HRSV(Memphis-37)__AIY60640.1__F0 (opt11)
  source 1..2111: mol_type = other RNA
gggagaggcgctgcctacggaggtggcagccatctccttctcggcatcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12079 - RNA, 2107 nt, synthetic construct
  misc_feature 1..2107: note = mRNA product Design i-2 comprising derived and/or modified sequence from HRSV(Memphis-37)__AIY60640.1__F0 (wt)
  source 1..2107: mol_type = other RNA
ggggcgctgcctacggaggtggcagccatctccttctcggcatcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12080 - RNA, 2107 nt, synthetic construct
  misc_feature 1..2107: note = mRNA product Design i-2 comprising derived and/or modified sequence from HRSV(Memphis-37)__AIY60640.1__F0 (opt1)
  source 1..2107: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12081 - RNA, 2107 nt, synthetic construct
  misc_feature 1..2107: note = mRNA product Design i-2 comprising derived and/or modified sequence from HRSV(Memphis-37)__AIY60640.1__F0 (opt2)
  source 1..2107: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12082 - RNA, 2107 nt, synthetic construct
  misc_feature 1..2107: note = mRNA product Design i-2 comprising derived and/or modified sequence from HRSV(Memphis-37)__AIY60640.1__F0 (opt3)
  source 1..2107: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12083 - RNA, 2107 nt, synthetic construct
  misc_feature 1..2107: note = mRNA product Design i-2 comprising derived and/or modified sequence from HRSV(Memphis-37)__AIY60640.1__F0 (opt4)
  source 1..2107: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12084 - RNA, 2107 nt, synthetic construct
  misc_feature 1..2107: note = mRNA product Design i-2 comprising derived and/or modified sequence from HRSV(Memphis-37)__AIY60640.1__F0 (opt5)
  source 1..2107: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12085 - RNA, 2107 nt, synthetic construct
  misc_feature 1..2107: note = mRNA product Design i-2 comprising derived and/or modified sequence from HRSV(Memphis-37)__AIY60640.1__F0 (opt6)
  source 1..2107: mol_type = other RNA
ggggcgctgcctacggaggtggcagccatctccttctcggcatcaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12086 - RNA, 2107 nt, synthetic construct
  misc_feature 1..2107: note = mRNA product Design i-2 comprising derived and/or modified sequence from HRSV(Memphis-37)__AIY60640.1__F0 (opt11)
  source 1..2107: mol_type = other RNA
ggggcgctgcctacggaggtggcagccatctccttctcggcatcaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12087 - RNA, 1942 nt, synthetic construct
  misc_feature 1..1942: note = mRNA product Design i-3 comprising derived and/or modified sequence from HRSV(Memphis-37)__AIY60640.1__F0 (wt)
  source 1..1942: mol_type = other RNA
gggagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagaagcacaccagtcacactaagcaaggatcaactgagtggtataaataatattgcatttagtaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12088 - RNA, 1942 nt, synthetic construct
  misc_feature 1..1942: note = mRNA product Design i-3 comprising derived and/or modified sequence from HRSV(Memphis-37)__AIY60640.1__F0 (opt1)
  source 1..1942: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12089 - RNA, 1942 nt, synthetic construct
  misc_feature 1..1942: note = mRNA product Design i-3 comprising derived and/or modified sequence from HRSV(Memphis-37)__AIY60640.1__F0 (opt2)
  source 1..1942: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12090 - RNA, 1942 nt, synthetic construct
  misc_feature 1..1942: note = mRNA product Design i-3 comprising derived and/or modified sequence from HRSV(Memphis-37)__AIY60640.1__F0 (opt3)
  source 1..1942: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtccactcctgtgacattgtcaaaggaccagctcagcggcattaataacatcgccttctctaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12091 - RNA, 1942 nt, synthetic construct
  misc_feature 1..1942: note = mRNA product Design i-3 comprising derived and/or modified sequence from HRSV(Memphis-37)__AIY60640.1__F0 (opt4)
  source 1..1942: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12092 - RNA, 1942 nt, synthetic construct
  misc_feature 1..1942: note = mRNA product Design i-3 comprising derived and/or modified sequence from HRSV(Memphis-37)__AIY60640.1__F0 (opt5)
  source 1..1942: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtctacaccggtgaccctgtccaaggaccagcttagcgggatcaataacattgccttctctaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12093 - RNA, 1942 nt, synthetic construct
  misc_feature 1..1942: note = mRNA product Design i-3 comprising derived and/or modified sequence from HRSV(Memphis-37)__AIY60640.1__F0 (opt6)
  source 1..1942: mol_type = other RNA
gggagaaagcttaccatggaactgcctattctaaaaacaaatgccataacaacaattcttgcagcagtaacattatgttttgcatcatcacaaaacattacagaagaattttaccaatccacttgctcagccgtatcaaaaggatacctatcagccttaagaacaggttggtacacctcagtaataaccatagaactatcaaacataaaagaaaacaaatgcaatggtactgatgcaaaagtcaaactaatcaaacaagaactggacaaatacaaaaatgcagtaaccgaactacaactcctaatgcaatccacacctgcagccaacaacagagcaagacgcgaactaccaagatttatgaattacacattaaacaacaccaagaacaacaatgtaactctctcaaaaaaaagaaaaagacgctttctaggtttcctcctaggcgtcggatctgcaatagcctcaggaatagcagtatcaaaagttctacacctagaaggagaagtaaacaaaattaaaaacgcattactatcaaccaacaaagcagttgtatccctttcaaatggagtctctgtacttacatcaaaagtactcgacctaaaaaactatatagacaaacaactactcccaatagtcaataagcaatcatgcagcatatcaaacatagaaacagttatagaatttcaacaaaaaaacaacagactactcgaaataaccagagaatttagcgtcaacgcaggcgtaaccacaccggtatccacatacatgcttacaaactcagaactcctctcactaataaacgacatgccaataactaatgaccaaaaaaaactaatgtcaaacaatgtccaaatagtccgtcaacaatcatactcaataatgtcaataataaaagaagaagtattagcatatgtagtccaactaccattatacggcgttatagacacaccttgttggaaacttcacacatccccactctgtacaaccaacacaaaagaaggttccaatatatgcctaactagaaccgacagaggatggtattgcgacaacgcaggatctgtatcattctttccccaagcagaaacatgtaaagtacaaagtaaccgcgtattctgcgacaccatgaactcattaaccctcccatccgaagttaatttatgcaatatagacatatttaatcctaaatacgactgcaaaataatgacatcaaaaacagacgttagttcctccgtaatcacatctttgggcgcaatagtctcatgctatggaaaaacaaaatgcacagcctcaaacaaaaatagaggaataataaaaacattcagcaacggctgtgattatgtatccaacaaaggagtagacacagtatccgtaggcaataccctttactacgttaataaacaagaaggaaaatcattatacgtcaaaggagaacctatcataaatttctacgacccattagtattcccttcagacgaatttgatgcctcaatatcccaagtcaatgaaaaaatcaaccaatcactagcctttatccgcaaatcagacgaattactacacaacgtaaacgtaggcaaatcaacaactaatataatgataacaacaataataatagtaattatagtaatattattactactaatcgccgtaggtttattcttatactgtaaagcacgatcaacaccagttacactctcaaaagatcaactatcaggaataaacaacatagcattttccaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12094 - RNA, 1942 nt, synthetic construct
  misc_feature 1..1942: note = mRNA product Design i-3 comprising derived and/or modified sequence from HRSV(Memphis-37)__AIY60640.1__F0 (opt11)
  source 1..1942: mol_type = other RNA
gggagaaagcttaccatggaactccccatcctcaaaacaaacgccataaccactatcctcgccgccgtcaccctctgcttcgcctcctcccaaaacatcacagaggagttctaccaatccacatgctccgccgtctccaaaggctacctcagcgccctacgtaccggctggtacaccagcgtcatcacaatagaactctccaacatcaaggaaaacaaatgcaacggcaccgatgccaaagtaaaactcatcaaacaagaactcgataaatacaaaaacgccgtcaccgaactacaactcctaatgcaaagcacacccgccgccaacaacagagcacggcgcgaactgccccgcttcatgaactacaccctcaacaacaccaaaaataacaacgtcaccctatccaagaaacgcaaacgccgattcctcggtttcctactcggcgtaggaagcgccatagcctcaggcatcgccgtctccaaagtcctccatctggaaggcgaagtcaacaaaatcaaaaacgcactcttatccaccaacaaagccgtcgtctccctctcgaacggggtctccgtccttacctccaaagtcctcgaccttaaaaactacatcgacaaacaactactaccaatagtcaataaacaatcctgctccatctcaaacatagaaaccgtcatagagttccaacagaagaacaatcgcctcctcgaaataactcgcgagttctccgtcaacgcaggcgtcacgacccctgtctcaacatacatgctaactaactcagaactcctaagcctaatcaacgacatgcccatcacaaacgaccaaaagaaactcatgagcaacaatgtccagatagtcagacagcaatcctatagcatcatgtctataataaaagaagaagtgctcgcctacgtagtccaactccctctttacggcgtcatagacacaccctgctggaaactccacacatctcctctctgcaccaccaacacaaaagaaggcagcaacatctgcctgacccgaaccgaccgcggatggtactgcgacaacgctggctccgtgtctttctttccccaagccgaaacctgcaaagtccagtccaaccgcgtcttctgcgacacaatgaactccctcaccctaccctccgaagttaacctctgcaacatcgacatcttcaatccaaaatacgactgcaaaatcatgacctcgaaaacggacgtatcctcctccgtcataacatcacttggagccatcgttagctgctacggaaaaaccaaatgtaccgcctccaacaaaaaccgcggaataatcaaaacattctccaacggctgcgactacgtaagcaacaaaggggtcgatactgtctccgtaggtaacaccctatactacgtcaacaaacaagaaggaaaatcactatacgttaaaggcgaacccattatcaacttctacgaccccctcgttttcccatccgacgagttcgacgcctccataagccaagttaacgaaaagataaaccaatcgctcgcattcatccgcaaatccgacgaactcctacacaacgtcaacgtgggcaaatccacaacaaacatcatgatcaccaccatcattatcgtcataatagtcatcctcctcctgctcatcgccgtgggactattcctatactgcaaagcccgctcgacgcccgtcacactttccaaagaccaactaagcggaatcaacaacatagcgttcagcaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12095 - protein, 553 aa, synthetic construct; identical to SEQ ID NO: 9653
  REGION 1..553: note = derived and/or modified protein sequence (wt) from HRSV(Memphis-37)__AIY60640.1__F-del

SEQ ID NO: 12096 - RNA, 1662 nt, synthetic construct
  misc_feature 1..1662: note = derived and/or modified CDS sequence (wt) from HRSV(Memphis-37)__AIY60640.1__F-del
  source 1..1662: mol_type = other RNA
atggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatga

SEQ ID NO: 12097 - RNA, 1662 nt, synthetic construct
  misc_feature 1..1662: note = derived and/or modified CDS sequence (opt1) from HRSV(Memphis-37)__AIY60640.1__F-del
  source 1..1662: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 12098 - RNA, 1662 nt, synthetic construct
  misc_feature 1..1662: note = derived and/or modified CDS sequence (opt2) from HRSV(Memphis-37)__AIY60640.1__F-del
  source 1..1662: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 12099 - RNA, 1662 nt, synthetic construct
  misc_feature 1..1662: note = derived and/or modified CDS sequence (opt3) from HRSV(Memphis-37)__AIY60640.1__F-del
  source 1..1662: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtga

SEQ ID NO: 12100 - RNA, 1662 nt, synthetic construct
  misc_feature 1..1662: note = derived and/or modified CDS sequence (opt4) from HRSV(Memphis-37)__AIY60640.1__F-del
  source 1..1662: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 12101 - RNA, 1662 nt, synthetic construct
  misc_feature 1..1662: note = derived and/or modified CDS sequence (opt5) from HRSV(Memphis-37)__AIY60640.1__F-del
  source 1..1662: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtga

SEQ ID NO: 12102 - RNA, 1662 nt, synthetic construct
  misc_feature 1..1662: note = derived and/or modified CDS sequence (opt6) from HRSV(Memphis-37)__AIY60640.1__F-del
  source 1..1662: mol_type = other RNA
atggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataa

SEQ ID NO: 12103 - RNA, 1662 nt, synthetic construct
  misc_feature 1..1662: note = derived and/or modified CDS sequence (opt11) from HRSV(Memphis-37)__AIY60640.1__F-del
  source 1..1662: mol_type = other RNA
atggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatga

SEQ ID NO: 12104 - RNA, 1938 nt, synthetic construct
  misc_feature 1..1938: note = mRNA product Design a-1 comprising derived and/or modified sequence from HRSV(Memphis-37)__AIY60640.1__F-del (wt)
  source 1..1938: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12105 - RNA, 1938 nt, synthetic construct
  misc_feature 1..1938: note = mRNA product Design a-1 comprising derived and/or modified sequence from HRSV(Memphis-37)__AIY60640.1__F-del (opt1)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12106 - RNA, 1938 nt, synthetic construct
  misc_feature 1..1938: note = mRNA product Design a-1 comprising derived and/or modified sequence from HRSV(Memphis-37)__AIY60640.1__F-del (opt2)
  source 1..1938: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12107 - RNA, 1938 nt, synthetic construct
  misc_feature 1..1938: note = mRNA product Design a-1 comprising derived and/or modified sequence from HRSV(Memphis-37)__AIY60640.1__F-del (opt3)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12108 - RNA, 1938 nt, synthetic construct
  misc_feature 1..1938: note = mRNA product Design a-1 comprising derived and/or modified sequence from HRSV(Memphis-37)__AIY60640.1__F-del (opt4)
  source 1..1938: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12109 - RNA, 1938 nt, synthetic construct
  misc_feature 1..1938: note = mRNA product Design a-1 comprising derived and/or modified sequence from HRSV(Memphis-37)__AIY60640.1__F-del (opt5)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12110 - RNA, 1938 nt, synthetic construct
  misc_feature 1..1938: note = mRNA product Design a-1 comprising derived and/or modified sequence from HRSV(Memphis-37)__AIY60640.1__F-del (opt6)
  source 1..1938: mol_type = other RNA
gggagagtcccgcagtcggcgtccagcggctctgcttgttcgtgtgtgtgtcgttgcaggccttattcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12111 - RNA, 1938 nt, synthetic construct
  misc_feature 1..1938: note = mRNA product Design a-1 comprising derived and/or modified sequence from HRSV(Memphis-37)__AIY60640.1__F-del (opt11)
  source 1..1938: mol_type = other RNA
gggagagtcccgcagtcggcgtccagcggctctgcttgttcgtgtgtgtgtcgttgcaggccttattcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12112 - RNA, 1957 nt, synthetic construct
  misc_feature 1..1957: note = mRNA product Design a-2 comprising derived and/or modified sequence from HRSV(Memphis-37)__AIY60640.1__F-del (wt)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12113 - RNA, 1957 nt, synthetic construct
  misc_feature 1..1957: note = mRNA product Design a-2 comprising derived and/or modified sequence from HRSV(Memphis-37)__AIY60640.1__F-del (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12114 - RNA, 1957 nt, synthetic construct
  misc_feature 1..1957: note = mRNA product Design a-2 comprising derived and/or modified sequence from HRSV(Memphis-37)__AIY60640.1__F-del (opt2)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12115 - RNA, 1957 nt, synthetic construct
  misc_feature 1..1957: note = mRNA product Design a-2 comprising derived and/or modified sequence from HRSV(Memphis-37)__AIY60640.1__F-del (opt3)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12116 - RNA, 1957 nt, synthetic construct
  misc_feature 1..1957: note = mRNA product Design a-2 comprising derived and/or modified sequence from HRSV(Memphis-37)__AIY60640.1__F-del (opt4)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12117 - RNA, 1957 nt, synthetic construct
  misc_feature 1..1957: note = mRNA product Design a-2 comprising derived and/or modified sequence from HRSV(Memphis-37)__AIY60640.1__F-del (opt5)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12118 - RNA, 1957 nt, synthetic construct
  misc_feature 1..1957: note = mRNA product Design a-2 comprising derived and/or modified sequence from HRSV(Memphis-37)__AIY60640.1__F-del (opt6)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12119 - RNA, 1957 nt, synthetic construct
  misc_feature 1..1957: note = mRNA product Design a-2 comprising derived and/or modified sequence from HRSV(Memphis-37)__AIY60640.1__F-del (opt11)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12120 - RNA, 2035 nt, synthetic construct
  misc_feature 1..2035: note = mRNA product Design a-3 comprising derived and/or modified sequence from HRSV(Memphis-37)__AIY60640.1__F-del (wt)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12121 - RNA, 2035 nt, synthetic construct
  misc_feature 1..2035: note = mRNA product Design a-3 comprising derived and/or modified sequence from HRSV(Memphis-37)__AIY60640.1__F-del (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12122 - RNA, 2035 nt, synthetic construct
  misc_feature 1..2035: note = mRNA product Design a-3 comprising derived and/or modified sequence from HRSV(Memphis-37)__AIY60640.1__F-del (opt2)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12123 - RNA, 2035 nt, synthetic construct
  misc_feature 1..2035: note = mRNA product Design a-3 comprising derived and/or modified sequence from HRSV(Memphis-37)__AIY60640.1__F-del (opt3)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12124 - RNA, 2035 nt, synthetic construct
  misc_feature 1..2035: note = mRNA product Design a-3 comprising derived and/or modified sequence from HRSV(Memphis-37)__AIY60640.1__F-del (opt4)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12125 - RNA, 2035 nt, synthetic construct
  misc_feature 1..2035: note = mRNA product Design a-3 comprising derived and/or modified sequence from HRSV(Memphis-37)__AIY60640.1__F-del (opt5)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12126 - RNA, 2035 nt, synthetic construct
  misc_feature 1..2035: note = mRNA product Design a-3 comprising derived and/or modified sequence from HRSV(Memphis-37)__AIY60640.1__F-del (opt6)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12127 - RNA, 2035 nt, synthetic construct
  misc_feature 1..2035: note = mRNA product Design a-3 comprising derived and/or modified sequence from HRSV(Memphis-37)__AIY60640.1__F-del (opt11)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12128 - RNA, 1984 nt, synthetic construct
  misc_feature 1..1984: note = mRNA product Design a-4 comprising derived and/or modified sequence from HRSV(Memphis-37)__AIY60640.1__F-del (wt)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12129 - RNA, 1984 nt, synthetic construct
  misc_feature 1..1984: note = mRNA product Design a-4 comprising derived and/or modified sequence from HRSV(Memphis-37)__AIY60640.1__F-del (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12130 - RNA, 1984 nt, synthetic construct
  misc_feature 1..1984: note = mRNA product Design a-4 comprising derived and/or modified sequence from HRSV(Memphis-37)__AIY60640.1__F-del (opt2)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12131 - RNA, 1984 nt, synthetic construct
  misc_feature 1..1984: note = mRNA product Design a-4 comprising derived and/or modified sequence from HRSV(Memphis-37)__AIY60640.1__F-del (opt3)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12132 - RNA, 1984 nt, synthetic construct
  misc_feature 1..1984: note = mRNA product Design a-4 comprising derived and/or modified sequence from HRSV(Memphis-37)__AIY60640.1__F-del (opt4)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12133 - RNA, 1984 nt, synthetic construct
  misc_feature 1..1984: note = mRNA product Design a-4 comprising derived and/or modified sequence from HRSV(Memphis-37)__AIY60640.1__F-del (opt5)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12134 - RNA, 1984 nt, synthetic construct
  misc_feature 1..1984: note = mRNA product Design a-4 comprising derived and/or modified sequence from HRSV(Memphis-37)__AIY60640.1__F-del (opt6)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12135 - RNA, 1984 nt, synthetic construct
  misc_feature 1..1984: note = mRNA product Design a-4 comprising derived and/or modified sequence from HRSV(Memphis-37)__AIY60640.1__F-del (opt11)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12136 - RNA, 1930 nt, synthetic construct
  misc_feature 1..1930: note = mRNA product Design a-5 comprising derived and/or modified sequence from HRSV(Memphis-37)__AIY60640.1__F-del (wt)
  source 1..1930: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12137 - RNA, 1930 nt, synthetic construct
  misc_feature 1..1930: note = mRNA product Design a-5 comprising derived and/or modified sequence from HRSV(Memphis-37)__AIY60640.1__F-del (opt1)
  source 1..1930: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12138 - RNA, 1930 nt, synthetic construct
  misc_feature 1..1930: note = mRNA product Design a-5 comprising derived and/or modified sequence from HRSV(Memphis-37)__AIY60640.1__F-del (opt2)
  source 1..1930: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12139 - RNA, 1930 nt, synthetic construct
  misc_feature 1..1930: note = mRNA product Design a-5 comprising derived and/or modified sequence from HRSV(Memphis-37)__AIY60640.1__F-del (opt3)
  source 1..1930: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12140 - RNA, 1930 nt, synthetic construct
  misc_feature 1..1930: note = mRNA product Design a-5 comprising derived and/or modified sequence from HRSV(Memphis-37)__AIY60640.1__F-del (opt4)
  source 1..1930: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12141 - RNA, 1930 nt, synthetic construct
  misc_feature 1..1930: note = mRNA product Design a-5 comprising derived and/or modified sequence from HRSV(Memphis-37)__AIY60640.1__F-del (opt5)
  source 1..1930: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12142 - RNA, 1930 nt, synthetic construct
  misc_feature 1..1930: note = mRNA product Design a-5 comprising derived and/or modified sequence from HRSV(Memphis-37)__AIY60640.1__F-del (opt6)
  source 1..1930: mol_type = other RNA
gggagactttcccattctgtagcagaatttggtgttgcctgtggtcttggtcccgcggagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12143 - RNA, 1930 nt, synthetic construct
  misc_feature 1..1930: note = mRNA product Design a-5 comprising derived and/or modified sequence from HRSV(Memphis-37)__AIY60640.1__F-del (opt11)
  source 1..1930: mol_type = other RNA
gggagactttcccattctgtagcagaatttggtgttgcctgtggtcttggtcccgcggagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12144 - RNA, 2111 nt, synthetic construct
  misc_feature 1..2111: note = mRNA product Design b-1 comprising derived and/or modified sequence from HRSV(Memphis-37)__AIY60640.1__F-del (wt)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12145 - RNA, 2111 nt, synthetic construct
  misc_feature 1..2111: note = mRNA product Design b-1 comprising derived and/or modified sequence from HRSV(Memphis-37)__AIY60640.1__F-del (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12146 - RNA, 2111 nt, synthetic construct
  misc_feature 1..2111: note = mRNA product Design b-1 comprising derived and/or modified sequence from HRSV(Memphis-37)__AIY60640.1__F-del (opt2)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12147 - RNA, 2111 nt, synthetic construct
  misc_feature 1..2111: note = mRNA product Design b-1 comprising derived and/or modified sequence from HRSV(Memphis-37)__AIY60640.1__F-del (opt3)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12148 - RNA, 2111 nt, synthetic construct
  misc_feature 1..2111: note = mRNA product Design b-1 comprising derived and/or modified sequence from HRSV(Memphis-37)__AIY60640.1__F-del (opt4)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12149 - RNA, 2111 nt, synthetic construct
  misc_feature 1..2111: note = mRNA product Design b-1 comprising derived and/or modified sequence from HRSV(Memphis-37)__AIY60640.1__F-del (opt5)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12150 - RNA, 2111 nt, synthetic construct
  misc_feature 1..2111: note = mRNA product Design b-1 comprising derived and/or modified sequence from HRSV(Memphis-37)__AIY60640.1__F-del (opt6)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12151 - RNA, 2111 nt, synthetic construct
  misc_feature 1..2111: note = mRNA product Design b-1 comprising derived and/or modified sequence from HRSV(Memphis-37)__AIY60640.1__F-del (opt11)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12152 - RNA, 1931 nt, synthetic construct
  misc_feature 1..1931: note = mRNA product Design b-2 comprising derived and/or modified sequence from HRSV(Memphis-37)__AIY60640.1__F-del (wt)
  source 1..1931: mol_type = other RNA
gggagagcctctgctggagtccggggagtggcgttggctgctagagcgaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12153 - RNA, 1931 nt, synthetic construct
  misc_feature 1..1931: note = mRNA product Design b-2 comprising derived and/or modified sequence from HRSV(Memphis-37)__AIY60640.1__F-del (opt1)
  source 1..1931: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12154 - RNA, 1931 nt, synthetic construct
  misc_feature 1..1931: note = mRNA product Design b-2 comprising derived and/or modified sequence from HRSV(Memphis-37)__AIY60640.1__F-del (opt2)
  source 1..1931: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12155 - RNA, 1931 nt, synthetic construct
  misc_feature 1..1931: note = mRNA product Design b-2 comprising derived and/or modified sequence from HRSV(Memphis-37)__AIY60640.1__F-del (opt3)
  source 1..1931: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12156 - RNA, 1931 nt, synthetic construct
  misc_feature 1..1931: note = mRNA product Design b-2 comprising derived and/or modified sequence from HRSV(Memphis-37)__AIY60640.1__F-del (opt4)
  source 1..1931: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12157 - RNA, 1931 nt, synthetic construct
  misc_feature 1..1931: note = mRNA product Design b-2 comprising derived and/or modified sequence from HRSV(Memphis-37)__AIY60640.1__F-del (opt5)
  source 1..1931: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12158 - RNA, 1931 nt, synthetic construct
  misc_feature 1..1931: note = mRNA product Design b-2 comprising derived and/or modified sequence from HRSV(Memphis-37)__AIY60640.1__F-del (opt6)
  source 1..1931: mol_type = other RNA
gggagagcctctgctggagtccggggagtggcgttggctgctagagcgaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12159 - RNA, 1931 nt, synthetic construct
  misc_feature 1..1931: note = mRNA product Design b-2 comprising derived and/or modified sequence from HRSV(Memphis-37)__AIY60640.1__F-del (opt11)
  source 1..1931: mol_type = other RNA
gggagagcctctgctggagtccggggagtggcgttggctgctagagcgaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12160 - RNA, 1951 nt, synthetic construct
  misc_feature 1..1951: note = mRNA product Design b-3 comprising derived and/or modified sequence from HRSV(Memphis-37)__AIY60640.1__F-del (wt)
  source 1..1951: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12161 - RNA, 1951 nt, synthetic construct
  misc_feature 1..1951: note = mRNA product Design b-3 comprising derived and/or modified sequence from HRSV(Memphis-37)__AIY60640.1__F-del (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12162 - RNA, 1951 nt, synthetic construct
  misc_feature 1..1951: note = mRNA product Design b-3 comprising derived and/or modified sequence from HRSV(Memphis-37)__AIY60640.1__F-del (opt2)
  source 1..1951: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12163 - RNA, 1951 nt, synthetic construct
  misc_feature 1..1951: note = mRNA product Design b-3 comprising derived and/or modified sequence from HRSV(Memphis-37)__AIY60640.1__F-del (opt3)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12164 - RNA, 1951 nt, synthetic construct
  misc_feature 1..1951: note = mRNA product Design b-3 comprising derived and/or modified sequence from HRSV(Memphis-37)__AIY60640.1__F-del (opt4)
  source 1..1951: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12165 - RNA, 1951 nt, synthetic construct
  misc_feature 1..1951: note = mRNA product Design b-3 comprising derived and/or modified sequence from HRSV(Memphis-37)__AIY60640.1__F-del (opt5)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12166 - RNA, 1951 nt, synthetic construct
  misc_feature 1..1951: note = mRNA product Design b-3 comprising derived and/or modified sequence from HRSV(Memphis-37)__AIY60640.1__F-del (opt6)
  source 1..1951: mol_type = other RNA
gggagagtcccgcagtcggcgtccagcggctctgcttgttcgtgtgtgtgtcgttgcaggccttattcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12167 - RNA, 1951 nt, synthetic construct
  misc_feature 1..1951: note = mRNA product Design b-3 comprising derived and/or modified sequence from HRSV(Memphis-37)__AIY60640.1__F-del (opt11)
  source 1..1951: mol_type = other RNA
gggagagtcccgcagtcggcgtccagcggctctgcttgttcgtgtgtgtgtcgttgcaggccttattcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12168 - RNA, 2002 nt, synthetic construct
  misc_feature 1..2002: note = mRNA product Design b-4 comprising derived and/or modified sequence from HRSV(Memphis-37)__AIY60640.1__F-del (wt)
  source 1..2002: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12169 - RNA, 2002 nt, synthetic construct
  misc_feature 1..2002: note = mRNA product Design b-4 comprising derived and/or modified sequence from HRSV(Memphis-37)__AIY60640.1__F-del (opt1)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12170 - RNA, 2002 nt, synthetic construct
  misc_feature 1..2002: note = mRNA product Design b-4 comprising derived and/or modified sequence from HRSV(Memphis-37)__AIY60640.1__F-del (opt2)
  source 1..2002: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12171 - RNA, 2002 nt, synthetic construct
  misc_feature 1..2002: note = mRNA product Design b-4 comprising derived and/or modified sequence from HRSV(Memphis-37)__AIY60640.1__F-del (opt3)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12172 - RNA, 2002 nt, synthetic construct
  misc_feature 1..2002: note = mRNA product Design b-4 comprising derived and/or modified sequence from HRSV(Memphis-37)__AIY60640.1__F-del (opt4)
  source 1..2002: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12173 - RNA, 2002 nt, synthetic construct
  misc_feature 1..2002: note = mRNA product Design b-4 comprising derived and/or modified sequence from HRSV(Memphis-37)__AIY60640.1__F-del (opt5)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12174 - RNA, 2002 nt, synthetic construct
  misc_feature 1..2002: note = mRNA product Design b-4 comprising derived and/or modified sequence from HRSV(Memphis-37)__AIY60640.1__F-del (opt6)
  source 1..2002: mol_type = other RNA
gggagagtcccgcagtcggcgtccagcggctctgcttgttcgtgtgtgtgtcgttgcaggccttattcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12175 - RNA, 2002 nt, synthetic construct
  misc_feature 1..2002: note = mRNA product Design b-4 comprising derived and/or modified sequence from HRSV(Memphis-37)__AIY60640.1__F-del (opt11)
  source 1..2002: mol_type = other RNA
gggagagtcccgcagtcggcgtccagcggctctgcttgttcgtgtgtgtgtcgttgcaggccttattcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12176 - RNA, 2064 nt, synthetic construct
  misc_feature 1..2064: note = mRNA product Design b-5 comprising derived and/or modified sequence from HRSV(Memphis-37)__AIY60640.1__F-del (wt)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12177 - RNA, 2064 nt, synthetic construct
  misc_feature 1..2064: note = mRNA product Design b-5 comprising derived and/or modified sequence from HRSV(Memphis-37)__AIY60640.1__F-del (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12178 - RNA, 2064 nt, synthetic construct
  misc_feature 1..2064: note = mRNA product Design b-5 comprising derived and/or modified sequence from HRSV(Memphis-37)__AIY60640.1__F-del (opt2)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12179 - RNA, 2064 nt, synthetic construct
  misc_feature 1..2064: note = mRNA product Design b-5 comprising derived and/or modified sequence from HRSV(Memphis-37)__AIY60640.1__F-del (opt3)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12180 - RNA, 2064 nt, synthetic construct
  misc_feature 1..2064: note = mRNA product Design b-5 comprising derived and/or modified sequence from HRSV(Memphis-37)__AIY60640.1__F-del (opt4)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12181 - RNA, 2064 nt, synthetic construct
  misc_feature 1..2064: note = mRNA product Design b-5 comprising derived and/or modified sequence from HRSV(Memphis-37)__AIY60640.1__F-del (opt5)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12182 - RNA, 2064 nt, synthetic construct
  misc_feature 1..2064: note = mRNA product Design b-5 comprising derived and/or modified sequence from HRSV(Memphis-37)__AIY60640.1__F-del (opt6)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12183 - RNA, 2064 nt, synthetic construct
  misc_feature 1..2064: note = mRNA product Design b-5 comprising derived and/or modified sequence from HRSV(Memphis-37)__AIY60640.1__F-del (opt11)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12184 - RNA, 1970 nt, synthetic construct
  misc_feature 1..1970: note = mRNA product Design c-1 comprising derived and/or modified sequence from HRSV(Memphis-37)__AIY60640.1__F-del (wt)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12185 - RNA, 1970 nt, synthetic construct
  misc_feature 1..1970: note = mRNA product Design c-1 comprising derived and/or modified sequence from HRSV(Memphis-37)__AIY60640.1__F-del (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12186 - RNA, 1970 nt, synthetic construct
  misc_feature 1..1970: note = mRNA product Design c-1 comprising derived and/or modified sequence from HRSV(Memphis-37)__AIY60640.1__F-del (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12187 - RNA, 1970 nt, synthetic construct
  misc_feature 1..1970: note = mRNA product Design c-1 comprising derived and/or modified sequence from HRSV(Memphis-37)__AIY60640.1__F-del (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12188 - RNA, 1970 nt, synthetic construct
  misc_feature 1..1970: note = mRNA product Design c-1 comprising derived and/or modified sequence from HRSV(Memphis-37)__AIY60640.1__F-del (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12189 - RNA, 1970 nt, synthetic construct
  misc_feature 1..1970: note = mRNA product Design c-1 comprising derived and/or modified sequence from HRSV(Memphis-37)__AIY60640.1__F-del (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12190 - RNA, 1970 nt, synthetic construct
  misc_feature 1..1970: note = mRNA product Design c-1 comprising derived and/or modified sequence from HRSV(Memphis-37)__AIY60640.1__F-del (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12191 - RNA, 1970 nt, synthetic construct
  misc_feature 1..1970: note = mRNA product Design c-1 comprising derived and/or modified sequence from HRSV(Memphis-37)__AIY60640.1__F-del (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12192 - RNA, 2060 nt, synthetic construct
  misc_feature 1..2060: note = mRNA product Design c-2 comprising derived and/or modified sequence from HRSV(Memphis-37)__AIY60640.1__F-del (wt)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12193 - RNA, 2060 nt, synthetic construct
  misc_feature 1..2060: note = mRNA product Design c-2 comprising derived and/or modified sequence from HRSV(Memphis-37)__AIY60640.1__F-del (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12194 - RNA, 2060 nt, synthetic construct
  misc_feature 1..2060: note = mRNA product Design c-2 comprising derived and/or modified sequence from HRSV(Memphis-37)__AIY60640.1__F-del (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12195 - RNA, 2060 nt, synthetic construct
  misc_feature 1..2060: note = mRNA product Design c-2 comprising derived and/or modified sequence from HRSV(Memphis-37)__AIY60640.1__F-del (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12196 - RNA, 2060 nt, synthetic construct
  misc_feature 1..2060: note = mRNA product Design c-2 comprising derived and/or modified sequence from HRSV(Memphis-37)__AIY60640.1__F-del (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12197 - RNA, 2060 nt, synthetic construct
  misc_feature 1..2060: note = mRNA product Design c-2 comprising derived and/or modified sequence from HRSV(Memphis-37)__AIY60640.1__F-del (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12198 - RNA, 2060 nt, synthetic construct
  misc_feature 1..2060: note = mRNA product Design c-2 comprising derived and/or modified sequence from HRSV(Memphis-37)__AIY60640.1__F-del (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12199 - RNA, 2060 nt, synthetic construct
  misc_feature 1..2060: note = mRNA product Design c-2 comprising derived and/or modified sequence from HRSV(Memphis-37)__AIY60640.1__F-del (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12200 - RNA, 2037 nt, synthetic construct
  misc_feature 1..2037: note = mRNA product Design c-3 comprising derived and/or modified sequence from HRSV(Memphis-37)__AIY60640.1__F-del (wt)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12201 - RNA, 2037 nt, synthetic construct
  misc_feature 1..2037: note = mRNA product Design c-3 comprising derived and/or modified sequence from HRSV(Memphis-37)__AIY60640.1__F-del (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12202 - RNA, 2037 nt, synthetic construct
  misc_feature 1..2037: note = mRNA product Design c-3 comprising derived and/or modified sequence from HRSV(Memphis-37)__AIY60640.1__F-del (opt2)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12203 - RNA, 2037 nt, synthetic construct
  misc_feature 1..2037: note = mRNA product Design c-3 comprising derived and/or modified sequence from HRSV(Memphis-37)__AIY60640.1__F-del (opt3)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12204 - RNA, 2037 nt, synthetic construct
  misc_feature 1..2037: note = mRNA product Design c-3 comprising derived and/or modified sequence from HRSV(Memphis-37)__AIY60640.1__F-del (opt4)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12205 - RNA, 2037 nt, synthetic construct
  misc_feature 1..2037: note = mRNA product Design c-3 comprising derived and/or modified sequence from HRSV(Memphis-37)__AIY60640.1__F-del (opt5)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12206 - RNA, 2037 nt, synthetic construct
  misc_feature 1..2037: note = mRNA product Design c-3 comprising derived and/or modified sequence from HRSV(Memphis-37)__AIY60640.1__F-del (opt6)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12207 - RNA, 2037 nt, synthetic construct
  misc_feature 1..2037: note = mRNA product Design c-3 comprising derived and/or modified sequence from HRSV(Memphis-37)__AIY60640.1__F-del (opt11)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12208 - RNA, 2033 nt, synthetic construct
  misc_feature 1..2033: note = mRNA product Design c-4 comprising derived and/or modified sequence from HRSV(Memphis-37)__AIY60640.1__F-del (wt)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12209 - RNA, 2033 nt, synthetic construct
  misc_feature 1..2033: note = mRNA product Design c-4 comprising derived and/or modified sequence from HRSV(Memphis-37)__AIY60640.1__F-del (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12210 - RNA, 2033 nt, synthetic construct
  misc_feature 1..2033: note = mRNA product Design c-4 comprising derived and/or modified sequence from HRSV(Memphis-37)__AIY60640.1__F-del (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12211 - RNA, 2033 nt, synthetic construct
  misc_feature 1..2033: note = mRNA product Design c-4 comprising derived and/or modified sequence from HRSV(Memphis-37)__AIY60640.1__F-del (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12212 - RNA, 2033 nt, synthetic construct
  misc_feature 1..2033: note = mRNA product Design c-4 comprising derived and/or modified sequence from HRSV(Memphis-37)__AIY60640.1__F-del (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12213 - RNA, 2033 nt, synthetic construct
  misc_feature 1..2033: note = mRNA product Design c-4 comprising derived and/or modified sequence from HRSV(Memphis-37)__AIY60640.1__F-del (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12214 - RNA, 2033 nt, synthetic construct
  misc_feature 1..2033: note = mRNA product Design c-4 comprising derived and/or modified sequence from HRSV(Memphis-37)__AIY60640.1__F-del (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12215 - RNA, 2033 nt, synthetic construct
  misc_feature 1..2033: note = mRNA product Design c-4 comprising derived and/or modified sequence from HRSV(Memphis-37)__AIY60640.1__F-del (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12216 - RNA, 1951 nt, synthetic construct
  misc_feature 1..1951: note = mRNA product Design c-5 comprising derived and/or modified sequence from HRSV(Memphis-37)__AIY60640.1__F-del (wt)
  source 1..1951: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12217 - RNA, 1951 nt, synthetic construct
  misc_feature 1..1951: note = mRNA product Design c-5 comprising derived and/or modified sequence from HRSV(Memphis-37)__AIY60640.1__F-del (opt1)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12218 - RNA, 1951 nt, synthetic construct
  misc_feature 1..1951: note = mRNA product Design c-5 comprising derived and/or modified sequence from HRSV(Memphis-37)__AIY60640.1__F-del (opt2)
  source 1..1951: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12219 - RNA, 1951 nt, synthetic construct
  misc_feature 1..1951: note = mRNA product Design c-5 comprising derived and/or modified sequence from HRSV(Memphis-37)__AIY60640.1__F-del (opt3)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12220 - RNA, 1951 nt, synthetic construct
  misc_feature 1..1951: note = mRNA product Design c-5 comprising derived and/or modified sequence from HRSV(Memphis-37)__AIY60640.1__F-del (opt4)
  source 1..1951: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12221 - RNA, 1951 nt, synthetic construct
  misc_feature 1..1951: note = mRNA product Design c-5 comprising derived and/or modified sequence from HRSV(Memphis-37)__AIY60640.1__F-del (opt5)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12222 - RNA, 1951 nt, synthetic construct
  misc_feature 1..1951: note = mRNA product Design c-5 comprising derived and/or modified sequence from HRSV(Memphis-37)__AIY60640.1__F-del (opt6)
  source 1..1951: mol_type = other RNA
gggagagcggctcggccattttgtcccagtcagtccggaggctgcggctgcagaagtaccgcctgcggagtaactgcaaagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12223 - RNA, 1951 nt, synthetic construct
  misc_feature 1..1951: note = mRNA product Design c-5 comprising derived and/or modified sequence from HRSV(Memphis-37)__AIY60640.1__F-del (opt11)
  source 1..1951: mol_type = other RNA
gggagagcggctcggccattttgtcccagtcagtccggaggctgcggctgcagaagtaccgcctgcggagtaactgcaaagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12224 - RNA, 1960 nt, synthetic construct
  misc_feature 1..1960: note = mRNA product Design d-1 comprising derived and/or modified sequence from HRSV(Memphis-37)__AIY60640.1__F-del (wt)
  source 1..1960: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12225 - RNA, 1960 nt, synthetic construct
  misc_feature 1..1960: note = mRNA product Design d-1 comprising derived and/or modified sequence from HRSV(Memphis-37)__AIY60640.1__F-del (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12226 - RNA, 1960 nt, synthetic construct
  misc_feature 1..1960: note = mRNA product Design d-1 comprising derived and/or modified sequence from HRSV(Memphis-37)__AIY60640.1__F-del (opt2)
  source 1..1960: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12227 - RNA, 1960 nt, synthetic construct
  misc_feature 1..1960: note = mRNA product Design d-1 comprising derived and/or modified sequence from HRSV(Memphis-37)__AIY60640.1__F-del (opt3)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12228 - RNA, 1960 nt, synthetic construct
  misc_feature 1..1960: note = mRNA product Design d-1 comprising derived and/or modified sequence from HRSV(Memphis-37)__AIY60640.1__F-del (opt4)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12229 - RNA, 1960 nt, synthetic construct
  misc_feature 1..1960: note = mRNA product Design d-1 comprising derived and/or modified sequence from HRSV(Memphis-37)__AIY60640.1__F-del (opt5)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12230 - RNA, 1960 nt, synthetic construct
  misc_feature 1..1960: note = mRNA product Design d-1 comprising derived and/or modified sequence from HRSV(Memphis-37)__AIY60640.1__F-del (opt6)
  source 1..1960: mol_type = other RNA
gggagacccgtgacccggaagttgtacggctacgcgactttccctcccacaaaccctcgcgcccttcctttcctacttgggcccggcagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12231 - RNA, 1960 nt, synthetic construct
  misc_feature 1..1960: note = mRNA product Design d-1 comprising derived and/or modified sequence from HRSV(Memphis-37)__AIY60640.1__F-del (opt11)
  source 1..1960: mol_type = other RNA
gggagacccgtgacccggaagttgtacggctacgcgactttccctcccacaaaccctcgcgcccttcctttcctacttgggcccggcagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12232 - RNA, 2015 nt, synthetic construct
  misc_feature 1..2015: note = mRNA product Design d-2 comprising derived and/or modified sequence from HRSV(Memphis-37)__AIY60640.1__F-del (wt)
  source 1..2015: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12233 - RNA, 2015 nt, synthetic construct
  misc_feature 1..2015: note = mRNA product Design d-2 comprising derived and/or modified sequence from HRSV(Memphis-37)__AIY60640.1__F-del (opt1)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12234 - RNA, 2015 nt, synthetic construct
  misc_feature 1..2015: note = mRNA product Design d-2 comprising derived and/or modified sequence from HRSV(Memphis-37)__AIY60640.1__F-del (opt2)
  source 1..2015: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12235 - RNA, 2015 nt, synthetic construct
  misc_feature 1..2015: note = mRNA product Design d-2 comprising derived and/or modified sequence from HRSV(Memphis-37)__AIY60640.1__F-del (opt3)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12236 - RNA, 2015 nt, synthetic construct
  misc_feature 1..2015: note = mRNA product Design d-2 comprising derived and/or modified sequence from HRSV(Memphis-37)__AIY60640.1__F-del (opt4)
  source 1..2015: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12237 - RNA, 2015 nt, synthetic construct
  misc_feature 1..2015: note = mRNA product Design d-2 comprising derived and/or modified sequence from HRSV(Memphis-37)__AIY60640.1__F-del (opt5)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12238 - RNA, 2015 nt, synthetic construct
  misc_feature 1..2015: note = mRNA product Design d-2 comprising derived and/or modified sequence from HRSV(Memphis-37)__AIY60640.1__F-del (opt6)
  source 1..2015: mol_type = other RNA
gggagagcggctcggccattttgtcccagtcagtccggaggctgcggctgcagaagtaccgcctgcggagtaactgcaaagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12239 - RNA, 2015 nt, synthetic construct
  misc_feature 1..2015: note = mRNA product Design d-2 comprising derived and/or modified sequence from HRSV(Memphis-37)__AIY60640.1__F-del (opt11)
  source 1..2015: mol_type = other RNA
gggagagcggctcggccattttgtcccagtcagtccggaggctgcggctgcagaagtaccgcctgcggagtaactgcaaagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12240 - RNA, 2331 nt, synthetic construct
  misc_feature 1..2331: note = mRNA product Design d-3 comprising derived and/or modified sequence from HRSV(Memphis-37)__AIY60640.1__F-del (wt)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12241 - RNA, 2331 nt, synthetic construct
  misc_feature 1..2331: note = mRNA product Design d-3 comprising derived and/or modified sequence from HRSV(Memphis-37)__AIY60640.1__F-del (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12242 - RNA, 2331 nt, synthetic construct
  misc_feature 1..2331: note = mRNA product Design d-3 comprising derived and/or modified sequence from HRSV(Memphis-37)__AIY60640.1__F-del (opt2)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12243 - RNA, 2331 nt, synthetic construct
  misc_feature 1..2331: note = mRNA product Design d-3 comprising derived and/or modified sequence from HRSV(Memphis-37)__AIY60640.1__F-del (opt3)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12244 - RNA, 2331 nt, synthetic construct
  misc_feature 1..2331: note = mRNA product Design d-3 comprising derived and/or modified sequence from HRSV(Memphis-37)__AIY60640.1__F-del (opt4)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12245 - RNA, 2331 nt, synthetic construct
  misc_feature 1..2331: note = mRNA product Design d-3 comprising derived and/or modified sequence from HRSV(Memphis-37)__AIY60640.1__F-del (opt5)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12246 - RNA, 2331 nt, synthetic construct
  misc_feature 1..2331: note = mRNA product Design d-3 comprising derived and/or modified sequence from HRSV(Memphis-37)__AIY60640.1__F-del (opt6)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12247 - RNA, 2331 nt, synthetic construct
  misc_feature 1..2331: note = mRNA product Design d-3 comprising derived and/or modified sequence from HRSV(Memphis-37)__AIY60640.1__F-del (opt11)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12248 - RNA, 2014 nt, synthetic construct
  misc_feature 1..2014: note = mRNA product Design d-4 comprising derived and/or modified sequence from HRSV(Memphis-37)__AIY60640.1__F-del (wt)
  source 1..2014: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12249 - RNA, 2014 nt, synthetic construct
  misc_feature 1..2014: note = mRNA product Design d-4 comprising derived and/or modified sequence from HRSV(Memphis-37)__AIY60640.1__F-del (opt1)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12250 - RNA, 2014 nt, synthetic construct
  misc_feature 1..2014: note = mRNA product Design d-4 comprising derived and/or modified sequence from HRSV(Memphis-37)__AIY60640.1__F-del (opt2)
  source 1..2014: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12251 - RNA, 2014 nt, synthetic construct
  misc_feature 1..2014: note = mRNA product Design d-4 comprising derived and/or modified sequence from HRSV(Memphis-37)__AIY60640.1__F-del (opt3)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12252 - RNA, 2014 nt, synthetic construct
  misc_feature 1..2014: note = mRNA product Design d-4 comprising derived and/or modified sequence from HRSV(Memphis-37)__AIY60640.1__F-del (opt4)
  source 1..2014: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12253 - RNA, 2014 nt, synthetic construct
  misc_feature 1..2014: note = mRNA product Design d-4 comprising derived and/or modified sequence from HRSV(Memphis-37)__AIY60640.1__F-del (opt5)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12254 - RNA, 2014 nt, synthetic construct
  misc_feature 1..2014: note = mRNA product Design d-4 comprising derived and/or modified sequence from HRSV(Memphis-37)__AIY60640.1__F-del (opt6)
  source 1..2014: mol_type = other RNA
gggagagtcccgcagtcggcgtccagcggctctgcttgttcgtgtgtgtgtcgttgcaggccttattcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12255 - RNA, 2014 nt, synthetic construct
  misc_feature 1..2014: note = mRNA product Design d-4 comprising derived and/or modified sequence from HRSV(Memphis-37)__AIY60640.1__F-del (opt11)
  source 1..2014: mol_type = other RNA
gggagagtcccgcagtcggcgtccagcggctctgcttgttcgtgtgtgtgtcgttgcaggccttattcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12256 - RNA, 2111 nt, synthetic construct
  misc_feature 1..2111: note = mRNA product Design d-5 comprising derived and/or modified sequence from HRSV(Memphis-37)__AIY60640.1__F-del (wt)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12257 - RNA, 2111 nt, synthetic construct
  misc_feature 1..2111: note = mRNA product Design d-5 comprising derived and/or modified sequence from HRSV(Memphis-37)__AIY60640.1__F-del (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12258 - RNA, 2111 nt, synthetic construct
  misc_feature 1..2111: note = mRNA product Design d-5 comprising derived and/or modified sequence from HRSV(Memphis-37)__AIY60640.1__F-del (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12259 - RNA, 2111 nt, synthetic construct
  misc_feature 1..2111: note = mRNA product Design d-5 comprising derived and/or modified sequence from HRSV(Memphis-37)__AIY60640.1__F-del (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12260 - RNA, 2111 nt, synthetic construct
  misc_feature 1..2111: note = mRNA product Design d-5 comprising derived and/or modified sequence from HRSV(Memphis-37)__AIY60640.1__F-del (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12261 - RNA, 2111 nt, synthetic construct
  misc_feature 1..2111: note = mRNA product Design d-5 comprising derived and/or modified sequence from HRSV(Memphis-37)__AIY60640.1__F-del (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12262 - RNA, 2111 nt, synthetic construct
  misc_feature 1..2111: note = mRNA product Design d-5 comprising derived and/or modified sequence from HRSV(Memphis-37)__AIY60640.1__F-del (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12263 - RNA, 2111 nt, synthetic construct
  misc_feature 1..2111: note = mRNA product Design d-5 comprising derived and/or modified sequence from HRSV(Memphis-37)__AIY60640.1__F-del (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12264 - RNA, 1991 nt, synthetic construct
  misc_feature 1..1991: note = mRNA product Design e-1 comprising derived and/or modified sequence from HRSV(Memphis-37)__AIY60640.1__F-del (wt)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12265 - RNA, 1991 nt, synthetic construct
  misc_feature 1..1991: note = mRNA product Design e-1 comprising derived and/or modified sequence from HRSV(Memphis-37)__AIY60640.1__F-del (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12266 - RNA, 1991 nt, synthetic construct
  misc_feature 1..1991: note = mRNA product Design e-1 comprising derived and/or modified sequence from HRSV(Memphis-37)__AIY60640.1__F-del (opt2)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12267 - RNA, 1991 nt, synthetic construct
  misc_feature 1..1991: note = mRNA product Design e-1 comprising derived and/or modified sequence from HRSV(Memphis-37)__AIY60640.1__F-del (opt3)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12268 - RNA, 1991 nt, synthetic construct
  misc_feature 1..1991: note = mRNA product Design e-1 comprising derived and/or modified sequence from HRSV(Memphis-37)__AIY60640.1__F-del (opt4)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12269 - RNA, 1991 nt, synthetic construct
  misc_feature 1..1991: note = mRNA product Design e-1 comprising derived and/or modified sequence from HRSV(Memphis-37)__AIY60640.1__F-del (opt5)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12270 - RNA, 1991 nt, synthetic construct
  misc_feature 1..1991: note = mRNA product Design e-1 comprising derived and/or modified sequence from HRSV(Memphis-37)__AIY60640.1__F-del (opt6)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12271 - RNA, 1991 nt, synthetic construct
  misc_feature 1..1991: note = mRNA product Design e-1 comprising derived and/or modified sequence from HRSV(Memphis-37)__AIY60640.1__F-del (opt11)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12272 - RNA, 1973 nt, synthetic construct
  misc_feature 1..1973: note = mRNA product Design e-2 comprising derived and/or modified sequence from HRSV(Memphis-37)__AIY60640.1__F-del (wt)
  source 1..1973: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12273 - RNA, 1973 nt, synthetic construct
  misc_feature 1..1973: note = mRNA product Design e-2 comprising derived and/or modified sequence from HRSV(Memphis-37)__AIY60640.1__F-del (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12274 - RNA, 1973 nt, synthetic construct
  misc_feature 1..1973: note = mRNA product Design e-2 comprising derived and/or modified sequence from HRSV(Memphis-37)__AIY60640.1__F-del (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12275 - RNA, 1973 nt, synthetic construct
  misc_feature 1..1973: note = mRNA product Design e-2 comprising derived and/or modified sequence from HRSV(Memphis-37)__AIY60640.1__F-del (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12276 - RNA, 1973 nt, synthetic construct
  misc_feature 1..1973: note = mRNA product Design e-2 comprising derived and/or modified sequence from HRSV(Memphis-37)__AIY60640.1__F-del (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12277 - RNA, 1973 nt, synthetic construct
  misc_feature 1..1973: note = mRNA product Design e-2 comprising derived and/or modified sequence from HRSV(Memphis-37)__AIY60640.1__F-del (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12278 - RNA, 1973 nt, synthetic construct
  misc_feature 1..1973: note = mRNA product Design e-2 comprising derived and/or modified sequence from HRSV(Memphis-37)__AIY60640.1__F-del (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12279 - RNA, 1973 nt, synthetic construct
  misc_feature 1..1973: note = mRNA product Design e-2 comprising derived and/or modified sequence from HRSV(Memphis-37)__AIY60640.1__F-del (opt11)
  source 1..1973: mol_type = other RNA
gggagacccgtgacccggaagttgtacggctacgcgactttccctcccacaaaccctcgcgcccttcctttcctacttgggcccggcagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12280 - RNA, 1943 nt, synthetic construct
  misc_feature 1..1943: note = mRNA product Design e-3 comprising derived and/or modified sequence from HRSV(Memphis-37)__AIY60640.1__F-del (wt)
  source 1..1943: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12281 - RNA, 1943 nt, synthetic construct
  misc_feature 1..1943: note = mRNA product Design e-3 comprising derived and/or modified sequence from HRSV(Memphis-37)__AIY60640.1__F-del (opt1)
  source 1..1943: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12282 - RNA, 1943 nt, synthetic construct
  misc_feature 1..1943: note = mRNA product Design e-3 comprising derived and/or modified sequence from HRSV(Memphis-37)__AIY60640.1__F-del (opt2)
  source 1..1943: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12283 - RNA, 1943 nt, synthetic construct
  misc_feature 1..1943: note = mRNA product Design e-3 comprising derived and/or modified sequence from HRSV(Memphis-37)__AIY60640.1__F-del (opt3)
  source 1..1943: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12284 - RNA, 1943 nt, synthetic construct
  misc_feature 1..1943: note = mRNA product Design e-3 comprising derived and/or modified sequence from HRSV(Memphis-37)__AIY60640.1__F-del (opt4)
  source 1..1943: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12285 - RNA, 1943 nt, synthetic construct
  misc_feature 1..1943: note = mRNA product Design e-3 comprising derived and/or modified sequence from HRSV(Memphis-37)__AIY60640.1__F-del (opt5)
  source 1..1943: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12286 - RNA, 1943 nt, synthetic construct
  misc_feature 1..1943: note = mRNA product Design e-3 comprising derived and/or modified sequence from HRSV(Memphis-37)__AIY60640.1__F-del (opt6)
  source 1..1943: mol_type = other RNA
gggagactttcccattctgtagcagaatttggtgttgcctgtggtcttggtcccgcggagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12287 - RNA, 1943 nt, synthetic construct
  misc_feature 1..1943: note = mRNA product Design e-3 comprising derived and/or modified sequence from HRSV(Memphis-37)__AIY60640.1__F-del (opt11)
  source 1..1943: mol_type = other RNA
gggagactttcccattctgtagcagaatttggtgttgcctgtggtcttggtcccgcggagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12288 - RNA, 1997 nt, synthetic construct
  misc_feature 1..1997: note = mRNA product Design e-4 comprising derived and/or modified sequence from HRSV(Memphis-37)__AIY60640.1__F-del (wt)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12289 - RNA, 1997 nt, synthetic construct
  misc_feature 1..1997: note = mRNA product Design e-4 comprising derived and/or modified sequence from HRSV(Memphis-37)__AIY60640.1__F-del (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12290 - RNA, 1997 nt, synthetic construct
  misc_feature 1..1997: note = mRNA product Design e-4 comprising derived and/or modified sequence from HRSV(Memphis-37)__AIY60640.1__F-del (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12291 - RNA, 1997 nt, synthetic construct
  misc_feature 1..1997: note = mRNA product Design e-4 comprising derived and/or modified sequence from HRSV(Memphis-37)__AIY60640.1__F-del (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12292 - RNA, 1997 nt, synthetic construct
  misc_feature 1..1997: note = mRNA product Design e-4 comprising derived and/or modified sequence from HRSV(Memphis-37)__AIY60640.1__F-del (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12293 - RNA, 1997 nt, synthetic construct
  misc_feature 1..1997: note = mRNA product Design e-4 comprising derived and/or modified sequence from HRSV(Memphis-37)__AIY60640.1__F-del (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12294 - RNA, 1997 nt, synthetic construct
  misc_feature 1..1997: note = mRNA product Design e-4 comprising derived and/or modified sequence from HRSV(Memphis-37)__AIY60640.1__F-del (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12295 - RNA, 1997 nt, synthetic construct
  misc_feature 1..1997: note = mRNA product Design e-4 comprising derived and/or modified sequence from HRSV(Memphis-37)__AIY60640.1__F-del (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12296 - RNA, 1964 nt, synthetic construct
  misc_feature 1..1964: note = mRNA product Design e-5 comprising derived and/or modified sequence from HRSV(Memphis-37)__AIY60640.1__F-del (wt)
  source 1..1964: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12297 - RNA, 1964 nt, synthetic construct
  misc_feature 1..1964: note = mRNA product Design e-5 comprising derived and/or modified sequence from HRSV(Memphis-37)__AIY60640.1__F-del (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12298 - RNA, 1964 nt, synthetic construct
  misc_feature 1..1964: note = mRNA product Design e-5 comprising derived and/or modified sequence from HRSV(Memphis-37)__AIY60640.1__F-del (opt2)
  source 1..1964: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12299 - RNA, 1964 nt, synthetic construct
  misc_feature 1..1964: note = mRNA product Design e-5 comprising derived and/or modified sequence from HRSV(Memphis-37)__AIY60640.1__F-del (opt3)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12300 - RNA, 1964 nt, synthetic construct
  misc_feature 1..1964: note = mRNA product Design e-5 comprising derived and/or modified sequence from HRSV(Memphis-37)__AIY60640.1__F-del (opt4)
  source 1..1964: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12301 - RNA, 1964 nt, synthetic construct
  misc_feature 1..1964: note = mRNA product Design e-5 comprising derived and/or modified sequence from HRSV(Memphis-37)__AIY60640.1__F-del (opt5)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12302 - RNA, 1964 nt, synthetic construct
  misc_feature 1..1964: note = mRNA product Design e-5 comprising derived and/or modified sequence from HRSV(Memphis-37)__AIY60640.1__F-del (opt6)
  source 1..1964: mol_type = other RNA
gggagagcggctcggccattttgtcccagtcagtccggaggctgcggctgcagaagtaccgcctgcggagtaactgcaaagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12303 - RNA, 1964 nt, synthetic construct
  misc_feature 1..1964: note = mRNA product Design e-5 comprising derived and/or modified sequence from HRSV(Memphis-37)__AIY60640.1__F-del (opt11)
  source 1..1964: mol_type = other RNA
gggagagcggctcggccattttgtcccagtcagtccggaggctgcggctgcagaagtaccgcctgcggagtaactgcaaagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12304 - RNA, 2031 nt, synthetic construct
  misc_feature 1..2031: note = mRNA product Design e-6 comprising derived and/or modified sequence from HRSV(Memphis-37)__AIY60640.1__F-del (wt)
  source 1..2031: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12305 - RNA, 2031 nt, synthetic construct
  misc_feature 1..2031: note = mRNA product Design e-6 comprising derived and/or modified sequence from HRSV(Memphis-37)__AIY60640.1__F-del (opt1)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12306 - RNA, 2031 nt, synthetic construct
  misc_feature 1..2031: note = mRNA product Design e-6 comprising derived and/or modified sequence from HRSV(Memphis-37)__AIY60640.1__F-del (opt2)
  source 1..2031: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12307 - RNA, 2031 nt, synthetic construct
  misc_feature 1..2031: note = mRNA product Design e-6 comprising derived and/or modified sequence from HRSV(Memphis-37)__AIY60640.1__F-del (opt3)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12308 - RNA, 2031 nt, synthetic construct
  misc_feature 1..2031: note = mRNA product Design e-6 comprising derived and/or modified sequence from HRSV(Memphis-37)__AIY60640.1__F-del (opt4)
  source 1..2031: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12309 - RNA, 2031 nt, synthetic construct
  misc_feature 1..2031: note = mRNA product Design e-6 comprising derived and/or modified sequence from HRSV(Memphis-37)__AIY60640.1__F-del (opt5)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12310 - RNA, 2031 nt, synthetic construct
  misc_feature 1..2031: note = mRNA product Design e-6 comprising derived and/or modified sequence from HRSV(Memphis-37)__AIY60640.1__F-del (opt6)
  source 1..2031: mol_type = other RNA
gggagagcggctcggccattttgtcccagtcagtccggaggctgcggctgcagaagtaccgcctgcggagtaactgcaaagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12311 - RNA, 2031 nt, synthetic construct
  misc_feature 1..2031: note = mRNA product Design e-6 comprising derived and/or modified sequence from HRSV(Memphis-37)__AIY60640.1__F-del (opt11)
  source 1..2031: mol_type = other RNA
gggagagcggctcggccattttgtcccagtcagtccggaggctgcggctgcagaagtaccgcctgcggagtaactgcaaagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12312 - RNA, 2247 nt, synthetic construct
  misc_feature 1..2247: note = mRNA product Design f-1 comprising derived and/or modified sequence from HRSV(Memphis-37)__AIY60640.1__F-del (wt)
  source 1..2247: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12313 - RNA, 2247 nt, synthetic construct
  misc_feature 1..2247: note = mRNA product Design f-1 comprising derived and/or modified sequence from HRSV(Memphis-37)__AIY60640.1__F-del (opt1)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12314 - RNA, 2247 nt, synthetic construct
  misc_feature 1..2247: note = mRNA product Design f-1 comprising derived and/or modified sequence from HRSV(Memphis-37)__AIY60640.1__F-del (opt2)
  source 1..2247: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12315 - RNA, 2247 nt, synthetic construct
  misc_feature 1..2247: note = mRNA product Design f-1 comprising derived and/or modified sequence from HRSV(Memphis-37)__AIY60640.1__F-del (opt3)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12316 - RNA, 2247 nt, synthetic construct
  misc_feature 1..2247: note = mRNA product Design f-1 comprising derived and/or modified sequence from HRSV(Memphis-37)__AIY60640.1__F-del (opt4)
  source 1..2247: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12317 - RNA, 2247 nt, synthetic construct
  misc_feature 1..2247: note = mRNA product Design f-1 comprising derived and/or modified sequence from HRSV(Memphis-37)__AIY60640.1__F-del (opt5)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12318 - RNA, 2247 nt, synthetic construct
  misc_feature 1..2247: note = mRNA product Design f-1 comprising derived and/or modified sequence from HRSV(Memphis-37)__AIY60640.1__F-del (opt6)
  source 1..2247: mol_type = other RNA
gggagagcggctcggccattttgtcccagtcagtccggaggctgcggctgcagaagtaccgcctgcggagtaactgcaaagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12319 - RNA, 2247 nt, synthetic construct
  misc_feature 1..2247: note = mRNA product Design f-1 comprising derived and/or modified sequence from HRSV(Memphis-37)__AIY60640.1__F-del (opt11)
  source 1..2247: mol_type = other RNA
gggagagcggctcggccattttgtcccagtcagtccggaggctgcggctgcagaagtaccgcctgcggagtaactgcaaagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12320 - RNA, 2027 nt, synthetic construct
  misc_feature 1..2027: note = mRNA product Design f-2 comprising derived and/or modified sequence from HRSV(Memphis-37)__AIY60640.1__F-del (wt)
  source 1..2027: mol_type = other RNA
gggagagcggctcggccattttgtcccagtcagtccggaggctgcggctgcagaagtaccgcctgcggagtaactgcaaagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12321 - RNA, 2027 nt, synthetic construct
  misc_feature 1..2027: note = mRNA product Design f-2 comprising derived and/or modified sequence from HRSV(Memphis-37)__AIY60640.1__F-del (opt1)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12322 - RNA, 2027 nt, synthetic construct
  misc_feature 1..2027: note = mRNA product Design f-2 comprising derived and/or modified sequence from HRSV(Memphis-37)__AIY60640.1__F-del (opt2)
  source 1..2027: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12323 - RNA, 2027 nt, synthetic construct
  misc_feature 1..2027: note = mRNA product Design f-2 comprising derived and/or modified sequence from HRSV(Memphis-37)__AIY60640.1__F-del (opt3)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12324 - RNA, 2027 nt, synthetic construct
  misc_feature 1..2027: note = mRNA product Design f-2 comprising derived and/or modified sequence from HRSV(Memphis-37)__AIY60640.1__F-del (opt4)
  source 1..2027: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12325 - RNA, 2027 nt, synthetic construct
  misc_feature 1..2027: note = mRNA product Design f-2 comprising derived and/or modified sequence from HRSV(Memphis-37)__AIY60640.1__F-del (opt5)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12326 - RNA, 2027 nt, synthetic construct
  misc_feature 1..2027: note = mRNA product Design f-2 comprising derived and/or modified sequence from HRSV(Memphis-37)__AIY60640.1__F-del (opt6)
  source 1..2027: mol_type = other RNA
gggagagcggctcggccattttgtcccagtcagtccggaggctgcggctgcagaagtaccgcctgcggagtaactgcaaagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12327 - RNA, 2027 nt, synthetic construct
  misc_feature 1..2027: note = mRNA product Design f-2 comprising derived and/or modified sequence from HRSV(Memphis-37)__AIY60640.1__F-del (opt11)
  source 1..2027: mol_type = other RNA
gggagagcggctcggccattttgtcccagtcagtccggaggctgcggctgcagaagtaccgcctgcggagtaactgcaaagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12328 - RNA, 2018 nt, synthetic construct
  misc_feature 1..2018: note = mRNA product Design f-3 comprising derived and/or modified sequence from HRSV(Memphis-37)__AIY60640.1__F-del (wt)
  source 1..2018: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12329 - RNA, 2018 nt, synthetic construct
  misc_feature 1..2018: note = mRNA product Design f-3 comprising derived and/or modified sequence from HRSV(Memphis-37)__AIY60640.1__F-del (opt1)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12330 - RNA, 2018 nt, synthetic construct
  misc_feature 1..2018: note = mRNA product Design f-3 comprising derived and/or modified sequence from HRSV(Memphis-37)__AIY60640.1__F-del (opt2)
  source 1..2018: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12331 - RNA, 2018 nt, synthetic construct
  misc_feature 1..2018: note = mRNA product Design f-3 comprising derived and/or modified sequence from HRSV(Memphis-37)__AIY60640.1__F-del (opt3)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12332 - RNA, 2018 nt, synthetic construct
  misc_feature 1..2018: note = mRNA product Design f-3 comprising derived and/or modified sequence from HRSV(Memphis-37)__AIY60640.1__F-del (opt4)
  source 1..2018: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12333 - RNA, 2018 nt, synthetic construct
  misc_feature 1..2018: note = mRNA product Design f-3 comprising derived and/or modified sequence from HRSV(Memphis-37)__AIY60640.1__F-del (opt5)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12334 - RNA, 2018 nt, synthetic construct
  misc_feature 1..2018: note = mRNA product Design f-3 comprising derived and/or modified sequence from HRSV(Memphis-37)__AIY60640.1__F-del (opt6)
  source 1..2018: mol_type = other RNA
gggagagtcccgcagtcggcgtccagcggctctgcttgttcgtgtgtgtgtcgttgcaggccttattcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12335 - RNA, 2018 nt, synthetic construct
  misc_feature 1..2018: note = mRNA product Design f-3 comprising derived and/or modified sequence from HRSV(Memphis-37)__AIY60640.1__F-del (opt11)
  source 1..2018: mol_type = other RNA
gggagagtcccgcagtcggcgtccagcggctctgcttgttcgtgtgtgtgtcgttgcaggccttattcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12336 - RNA, 2234 nt, synthetic construct
  misc_feature 1..2234: note = mRNA product Design f-4 comprising derived and/or modified sequence from HRSV(Memphis-37)__AIY60640.1__F-del (wt)
  source 1..2234: mol_type = other RNA
gggagagtcccgcagtcggcgtccagcggctctgcttgttcgtgtgtgtgtcgttgcaggccttattcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12337 - RNA, 2234 nt, synthetic construct
  misc_feature 1..2234: note = mRNA product Design f-4 comprising derived and/or modified sequence from HRSV(Memphis-37)__AIY60640.1__F-del (opt1)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12338 - RNA, 2234 nt, synthetic construct
  misc_feature 1..2234: note = mRNA product Design f-4 comprising derived and/or modified sequence from HRSV(Memphis-37)__AIY60640.1__F-del (opt2)
  source 1..2234: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12339 - RNA, 2234 nt, synthetic construct
  misc_feature 1..2234: note = mRNA product Design f-4 comprising derived and/or modified sequence from HRSV(Memphis-37)__AIY60640.1__F-del (opt3)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12340 - RNA, 2234 nt, synthetic construct
  misc_feature 1..2234: note = mRNA product Design f-4 comprising derived and/or modified sequence from HRSV(Memphis-37)__AIY60640.1__F-del (opt4)
  source 1..2234: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12341 - RNA, 2234 nt, synthetic construct
  misc_feature 1..2234: note = mRNA product Design f-4 comprising derived and/or modified sequence from HRSV(Memphis-37)__AIY60640.1__F-del (opt5)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12342 - RNA, 2234 nt, synthetic construct
  misc_feature 1..2234: note = mRNA product Design f-4 comprising derived and/or modified sequence from HRSV(Memphis-37)__AIY60640.1__F-del (opt6)
  source 1..2234: mol_type = other RNA
gggagagtcccgcagtcggcgtccagcggctctgcttgttcgtgtgtgtgtcgttgcaggccttattcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12343 - RNA, 2234 nt, synthetic construct
  misc_feature 1..2234: note = mRNA product Design f-4 comprising derived and/or modified sequence from HRSV(Memphis-37)__AIY60640.1__F-del (opt11)
  source 1..2234: mol_type = other RNA
gggagagtcccgcagtcggcgtccagcggctctgcttgttcgtgtgtgtgtcgttgcaggccttattcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12344 - RNA, 2010 nt, synthetic construct
  misc_feature 1..2010: note = mRNA product Design f-5 comprising derived and/or modified sequence from HRSV(Memphis-37)__AIY60640.1__F-del (wt)
  source 1..2010: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12345 - RNA, 2010 nt, synthetic construct
  misc_feature 1..2010: note = mRNA product Design f-5 comprising derived and/or modified sequence from HRSV(Memphis-37)__AIY60640.1__F-del (opt1)
  source 1..2010: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12346 - RNA, 2010 nt, synthetic construct
  misc_feature 1..2010: note = mRNA product Design f-5 comprising derived and/or modified sequence from HRSV(Memphis-37)__AIY60640.1__F-del (opt2)
  source 1..2010: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12347 - RNA, 2010 nt, synthetic construct
  misc_feature 1..2010: note = mRNA product Design f-5 comprising derived and/or modified sequence from HRSV(Memphis-37)__AIY60640.1__F-del (opt3)
  source 1..2010: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12348 - RNA, 2010 nt, synthetic construct
  misc_feature 1..2010: note = mRNA product Design f-5 comprising derived and/or modified sequence from HRSV(Memphis-37)__AIY60640.1__F-del (opt4)
  source 1..2010: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12349 - RNA, 2010 nt, synthetic construct
  misc_feature 1..2010: note = mRNA product Design f-5 comprising derived and/or modified sequence from HRSV(Memphis-37)__AIY60640.1__F-del (opt5)
  source 1..2010: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12350 - RNA, 2010 nt, synthetic construct
  misc_feature 1..2010: note = mRNA product Design f-5 comprising derived and/or modified sequence from HRSV(Memphis-37)__AIY60640.1__F-del (opt6)
  source 1..2010: mol_type = other RNA
gggagactttcccattctgtagcagaatttggtgttgcctgtggtcttggtcccgcggagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12351 - RNA, 2010 nt, synthetic construct
  misc_feature 1..2010: note = mRNA product Design f-5 comprising derived and/or modified sequence from HRSV(Memphis-37)__AIY60640.1__F-del (opt11)
  source 1..2010: mol_type = other RNA
gggagactttcccattctgtagcagaatttggtgttgcctgtggtcttggtcccgcggagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12352 - RNA, 2006 nt, synthetic construct
  misc_feature 1..2006: note = mRNA product Design g-1 comprising derived and/or modified sequence from HRSV(Memphis-37)__AIY60640.1__F-del (wt)
  source 1..2006: mol_type = other RNA
gggagactttcccattctgtagcagaatttggtgttgcctgtggtcttggtcccgcggagaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12353 - RNA, 2006 nt, synthetic construct
  misc_feature 1..2006: note = mRNA product Design g-1 comprising derived and/or modified sequence from HRSV(Memphis-37)__AIY60640.1__F-del (opt1)
  source 1..2006: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12354 - RNA, 2006 nt, synthetic construct
  misc_feature 1..2006: note = mRNA product Design g-1 comprising derived and/or modified sequence from HRSV(Memphis-37)__AIY60640.1__F-del (opt2)
  source 1..2006: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12355 - RNA, 2006 nt, synthetic construct
  misc_feature 1..2006: note = mRNA product Design g-1 comprising derived and/or modified sequence from HRSV(Memphis-37)__AIY60640.1__F-del (opt3)
  source 1..2006: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12356 - RNA, 2006 nt, synthetic construct
  misc_feature 1..2006: note = mRNA product Design g-1 comprising derived and/or modified sequence from HRSV(Memphis-37)__AIY60640.1__F-del (opt4)
  source 1..2006: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12357 - RNA, 2006 nt, synthetic construct
  misc_feature 1..2006: note = mRNA product Design g-1 comprising derived and/or modified sequence from HRSV(Memphis-37)__AIY60640.1__F-del (opt5)
  source 1..2006: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12358 - RNA, 2006 nt, synthetic construct
  misc_feature 1..2006: note = mRNA product Design g-1 comprising derived and/or modified sequence from HRSV(Memphis-37)__AIY60640.1__F-del (opt6)
  source 1..2006: mol_type = other RNA
gggagactttcccattctgtagcagaatttggtgttgcctgtggtcttggtcccgcggagaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12359 - RNA, 2006 nt, synthetic construct
  misc_feature 1..2006: note = mRNA product Design g-1 comprising derived and/or modified sequence from HRSV(Memphis-37)__AIY60640.1__F-del (opt11)
  source 1..2006: mol_type = other RNA
gggagactttcccattctgtagcagaatttggtgttgcctgtggtcttggtcccgcggagaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12360 - RNA, 2021 nt, synthetic construct
  misc_feature 1..2021: note = mRNA product Design g-2 comprising derived and/or modified sequence from HRSV(Memphis-37)__AIY60640.1__F-del (wt)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12361 - RNA, 2021 nt, synthetic construct
  misc_feature 1..2021: note = mRNA product Design g-2 comprising derived and/or modified sequence from HRSV(Memphis-37)__AIY60640.1__F-del (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12362 - RNA, 2021 nt, synthetic construct
  misc_feature 1..2021: note = mRNA product Design g-2 comprising derived and/or modified sequence from HRSV(Memphis-37)__AIY60640.1__F-del (opt2)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12363 - RNA, 2021 nt, synthetic construct
  misc_feature 1..2021: note = mRNA product Design g-2 comprising derived and/or modified sequence from HRSV(Memphis-37)__AIY60640.1__F-del (opt3)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12364 - RNA, 2021 nt, synthetic construct
  misc_feature 1..2021: note = mRNA product Design g-2 comprising derived and/or modified sequence from HRSV(Memphis-37)__AIY60640.1__F-del (opt4)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12365 - RNA, 2021 nt, synthetic construct
  misc_feature 1..2021: note = mRNA product Design g-2 comprising derived and/or modified sequence from HRSV(Memphis-37)__AIY60640.1__F-del (opt5)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12366 - RNA, 2021 nt, synthetic construct
  misc_feature 1..2021: note = mRNA product Design g-2 comprising derived and/or modified sequence from HRSV(Memphis-37)__AIY60640.1__F-del (opt6)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12367 - RNA, 2021 nt, synthetic construct
  misc_feature 1..2021: note = mRNA product Design g-2 comprising derived and/or modified sequence from HRSV(Memphis-37)__AIY60640.1__F-del (opt11)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12368 - RNA, 2253 nt, synthetic construct
  misc_feature 1..2253: note = mRNA product Design g-3 comprising derived and/or modified sequence from HRSV(Memphis-37)__AIY60640.1__F-del (wt)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12369 - RNA, 2253 nt, synthetic construct
  misc_feature 1..2253: note = mRNA product Design g-3 comprising derived and/or modified sequence from HRSV(Memphis-37)__AIY60640.1__F-del (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12370 - RNA, 2253 nt, synthetic construct
  misc_feature 1..2253: note = mRNA product Design g-3 comprising derived and/or modified sequence from HRSV(Memphis-37)__AIY60640.1__F-del (opt2)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12371 - RNA, 2253 nt, synthetic construct
  misc_feature 1..2253: note = mRNA product Design g-3 comprising derived and/or modified sequence from HRSV(Memphis-37)__AIY60640.1__F-del (opt3)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12372 - RNA, 2253 nt, synthetic construct
  misc_feature 1..2253: note = mRNA product Design g-3 comprising derived and/or modified sequence from HRSV(Memphis-37)__AIY60640.1__F-del (opt4)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12373 - RNA, 2253 nt, synthetic construct
  misc_feature 1..2253: note = mRNA product Design g-3 comprising derived and/or modified sequence from HRSV(Memphis-37)__AIY60640.1__F-del (opt5)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12374 - RNA, 2253 nt, synthetic construct
  misc_feature 1..2253: note = mRNA product Design g-3 comprising derived and/or modified sequence from HRSV(Memphis-37)__AIY60640.1__F-del (opt6)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12375 - RNA, 2253 nt, synthetic construct
  misc_feature 1..2253: note = mRNA product Design g-3 comprising derived and/or modified sequence from HRSV(Memphis-37)__AIY60640.1__F-del (opt11)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12376 - RNA, 2048 nt, synthetic construct
  misc_feature 1..2048: note = mRNA product Design g-4 comprising derived and/or modified sequence from HRSV(Memphis-37)__AIY60640.1__F-del (wt)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12377 - RNA, 2048 nt, synthetic construct
  misc_feature 1..2048: note = mRNA product Design g-4 comprising derived and/or modified sequence from HRSV(Memphis-37)__AIY60640.1__F-del (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12378 - RNA, 2048 nt, synthetic construct
  misc_feature 1..2048: note = mRNA product Design g-4 comprising derived and/or modified sequence from HRSV(Memphis-37)__AIY60640.1__F-del (opt2)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12379 - RNA, 2048 nt, synthetic construct
  misc_feature 1..2048: note = mRNA product Design g-4 comprising derived and/or modified sequence from HRSV(Memphis-37)__AIY60640.1__F-del (opt3)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12380 - RNA, 2048 nt, synthetic construct
  misc_feature 1..2048: note = mRNA product Design g-4 comprising derived and/or modified sequence from HRSV(Memphis-37)__AIY60640.1__F-del (opt4)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12381 - RNA, 2048 nt, synthetic construct
  misc_feature 1..2048: note = mRNA product Design g-4 comprising derived and/or modified sequence from HRSV(Memphis-37)__AIY60640.1__F-del (opt5)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12382 - RNA, 2048 nt, synthetic construct
  misc_feature 1..2048: note = mRNA product Design g-4 comprising derived and/or modified sequence from HRSV(Memphis-37)__AIY60640.1__F-del (opt6)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12383 - RNA, 2048 nt, synthetic construct
  misc_feature 1..2048: note = mRNA product Design g-4 comprising derived and/or modified sequence from HRSV(Memphis-37)__AIY60640.1__F-del (opt11)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12384 - RNA, 2024 nt, synthetic construct
  misc_feature 1..2024: note = mRNA product Design g-5 comprising derived and/or modified sequence from HRSV(Memphis-37)__AIY60640.1__F-del (wt)
  source 1..2024: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12385 - RNA, 2024 nt, synthetic construct
  misc_feature 1..2024: note = mRNA product Design g-5 comprising derived and/or modified sequence from HRSV(Memphis-37)__AIY60640.1__F-del (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12386 - RNA, 2024 nt, synthetic construct
  misc_feature 1..2024: note = mRNA product Design g-5 comprising derived and/or modified sequence from HRSV(Memphis-37)__AIY60640.1__F-del (opt2)
  source 1..2024: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12387 - RNA, 2024 nt, synthetic construct
  misc_feature 1..2024: note = mRNA product Design g-5 comprising derived and/or modified sequence from HRSV(Memphis-37)__AIY60640.1__F-del (opt3)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12388 - RNA, 2024 nt, synthetic construct
  misc_feature 1..2024: note = mRNA product Design g-5 comprising derived and/or modified sequence from HRSV(Memphis-37)__AIY60640.1__F-del (opt4)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12389 - RNA, 2024 nt, synthetic construct
  misc_feature 1..2024: note = mRNA product Design g-5 comprising derived and/or modified sequence from HRSV(Memphis-37)__AIY60640.1__F-del (opt5)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12390 - RNA, 2024 nt, synthetic construct
  misc_feature 1..2024: note = mRNA product Design g-5 comprising derived and/or modified sequence from HRSV(Memphis-37)__AIY60640.1__F-del (opt6)
  source 1..2024: mol_type = other RNA
gggagacccgtgacccggaagttgtacggctacgcgactttccctcccacaaaccctcgcgcccttcctttcctacttgggcccggcagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12391 - RNA, 2024 nt, synthetic construct
  misc_feature 1..2024: note = mRNA product Design g-5 comprising derived and/or modified sequence from HRSV(Memphis-37)__AIY60640.1__F-del (opt11)
  source 1..2024: mol_type = other RNA
gggagacccgtgacccggaagttgtacggctacgcgactttccctcccacaaaccctcgcgcccttcctttcctacttgggcccggcagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12392 - RNA, 2040 nt, synthetic construct
  misc_feature 1..2040: note = mRNA product Design h-1 comprising derived and/or modified sequence from HRSV(Memphis-37)__AIY60640.1__F-del (wt)
  source 1..2040: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12393 - RNA, 2040 nt, synthetic construct
  misc_feature 1..2040: note = mRNA product Design h-1 comprising derived and/or modified sequence from HRSV(Memphis-37)__AIY60640.1__F-del (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12394 - RNA, 2040 nt, synthetic construct
  misc_feature 1..2040: note = mRNA product Design h-1 comprising derived and/or modified sequence from HRSV(Memphis-37)__AIY60640.1__F-del (opt2)
  source 1..2040: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12395 - RNA, 2040 nt, synthetic construct
  misc_feature 1..2040: note = mRNA product Design h-1 comprising derived and/or modified sequence from HRSV(Memphis-37)__AIY60640.1__F-del (opt3)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12396 - RNA, 2040 nt, synthetic construct
  misc_feature 1..2040: note = mRNA product Design h-1 comprising derived and/or modified sequence from HRSV(Memphis-37)__AIY60640.1__F-del (opt4)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12397 - RNA, 2040 nt, synthetic construct
  misc_feature 1..2040: note = mRNA product Design h-1 comprising derived and/or modified sequence from HRSV(Memphis-37)__AIY60640.1__F-del (opt5)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12398 - RNA, 2040 nt, synthetic construct
  misc_feature 1..2040: note = mRNA product Design h-1 comprising derived and/or modified sequence from HRSV(Memphis-37)__AIY60640.1__F-del (opt6)
  source 1..2040: mol_type = other RNA
gggagacccgtgacccggaagttgtacggctacgcgactttccctcccacaaaccctcgcgcccttcctttcctacttgggcccggcagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12399 - RNA, 2040 nt, synthetic construct
  misc_feature 1..2040: note = mRNA product Design h-1 comprising derived and/or modified sequence from HRSV(Memphis-37)__AIY60640.1__F-del (opt11)
  source 1..2040: mol_type = other RNA
gggagacccgtgacccggaagttgtacggctacgcgactttccctcccacaaaccctcgcgcccttcctttcctacttgggcccggcagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12400 - RNA, 2256 nt, synthetic construct
  misc_feature 1..2256: note = mRNA product Design h-2 comprising derived and/or modified sequence from HRSV(Memphis-37)__AIY60640.1__F-del (wt)
  source 1..2256: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12401 - RNA, 2256 nt, synthetic construct
  misc_feature 1..2256: note = mRNA product Design h-2 comprising derived and/or modified sequence from HRSV(Memphis-37)__AIY60640.1__F-del (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12402 - RNA, 2256 nt, synthetic construct
  misc_feature 1..2256: note = mRNA product Design h-2 comprising derived and/or modified sequence from HRSV(Memphis-37)__AIY60640.1__F-del (opt2)
  source 1..2256: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12403 - RNA, 2256 nt, synthetic construct
  misc_feature 1..2256: note = mRNA product Design h-2 comprising derived and/or modified sequence from HRSV(Memphis-37)__AIY60640.1__F-del (opt3)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12404 - RNA, 2256 nt, synthetic construct
  misc_feature 1..2256: note = mRNA product Design h-2 comprising derived and/or modified sequence from HRSV(Memphis-37)__AIY60640.1__F-del (opt4)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12405 - RNA, 2256 nt, synthetic construct
  misc_feature 1..2256: note = mRNA product Design h-2 comprising derived and/or modified sequence from HRSV(Memphis-37)__AIY60640.1__F-del (opt5)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12406 - RNA, 2256 nt, synthetic construct
  misc_feature 1..2256: note = mRNA product Design h-2 comprising derived and/or modified sequence from HRSV(Memphis-37)__AIY60640.1__F-del (opt6)
  source 1..2256: mol_type = other RNA
gggagacccgtgacccggaagttgtacggctacgcgactttccctcccacaaaccctcgcgcccttcctttcctacttgggcccggcagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12407 - RNA, 2256 nt, synthetic construct
  misc_feature 1..2256: note = mRNA product Design h-2 comprising derived and/or modified sequence from HRSV(Memphis-37)__AIY60640.1__F-del (opt11)
  source 1..2256: mol_type = other RNA
gggagacccgtgacccggaagttgtacggctacgcgactttccctcccacaaaccctcgcgcccttcctttcctacttgggcccggcagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12408 - RNA, 2036 nt, synthetic construct
  misc_feature 1..2036: note = mRNA product Design h-3 comprising derived and/or modified sequence from HRSV(Memphis-37)__AIY60640.1__F-del (wt)
  source 1..2036: mol_type = other RNA
gggagacccgtgacccggaagttgtacggctacgcgactttccctcccacaaaccctcgcgcccttcctttcctacttgggcccggcagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12409 - RNA, 2036 nt, synthetic construct
  misc_feature 1..2036: note = mRNA product Design h-3 comprising derived and/or modified sequence from HRSV(Memphis-37)__AIY60640.1__F-del (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12410 - RNA, 2036 nt, synthetic construct
  misc_feature 1..2036: note = mRNA product Design h-3 comprising derived and/or modified sequence from HRSV(Memphis-37)__AIY60640.1__F-del (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12411 - RNA, 2036 nt, synthetic construct
  misc_feature 1..2036: note = mRNA product Design h-3 comprising derived and/or modified sequence from HRSV(Memphis-37)__AIY60640.1__F-del (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12412 - RNA, 2036 nt, synthetic construct
  misc_feature 1..2036: note = mRNA product Design h-3 comprising derived and/or modified sequence from HRSV(Memphis-37)__AIY60640.1__F-del (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12413 - RNA, 2036 nt, synthetic construct
  misc_feature 1..2036: note = mRNA product Design h-3 comprising derived and/or modified sequence from HRSV(Memphis-37)__AIY60640.1__F-del (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12414 - RNA, 2036 nt, synthetic construct
  misc_feature 1..2036: note = mRNA product Design h-3 comprising derived and/or modified sequence from HRSV(Memphis-37)__AIY60640.1__F-del (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12415 - RNA, 2036 nt, synthetic construct
  misc_feature 1..2036: note = mRNA product Design h-3 comprising derived and/or modified sequence from HRSV(Memphis-37)__AIY60640.1__F-del (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12416 - RNA, 2099 nt, synthetic construct
  misc_feature 1..2099: note = mRNA product Design h-4 comprising derived and/or modified sequence from HRSV(Memphis-37)__AIY60640.1__F-del (wt)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12417 - RNA, 2099 nt, synthetic construct
  misc_feature 1..2099: note = mRNA product Design h-4 comprising derived and/or modified sequence from HRSV(Memphis-37)__AIY60640.1__F-del (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12418 - RNA, 2099 nt, synthetic construct
  misc_feature 1..2099: note = mRNA product Design h-4 comprising derived and/or modified sequence from HRSV(Memphis-37)__AIY60640.1__F-del (opt2)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12419 - RNA, 2099 nt, synthetic construct
  misc_feature 1..2099: note = mRNA product Design h-4 comprising derived and/or modified sequence from HRSV(Memphis-37)__AIY60640.1__F-del (opt3)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12420 - RNA, 2099 nt, synthetic construct
  misc_feature 1..2099: note = mRNA product Design h-4 comprising derived and/or modified sequence from HRSV(Memphis-37)__AIY60640.1__F-del (opt4)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12421 - RNA, 2099 nt, synthetic construct
  misc_feature 1..2099: note = mRNA product Design h-4 comprising derived and/or modified sequence from HRSV(Memphis-37)__AIY60640.1__F-del (opt5)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12422 - RNA, 2099 nt, synthetic construct
  misc_feature 1..2099: note = mRNA product Design h-4 comprising derived and/or modified sequence from HRSV(Memphis-37)__AIY60640.1__F-del (opt6)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12423 - RNA, 2099 nt, synthetic construct
  misc_feature 1..2099: note = mRNA product Design h-4 comprising derived and/or modified sequence from HRSV(Memphis-37)__AIY60640.1__F-del (opt11)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12424 - RNA, 2115 nt, synthetic construct
  misc_feature 1..2115: note = mRNA product Design h-5 comprising derived and/or modified sequence from HRSV(Memphis-37)__AIY60640.1__F-del (wt)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12425 - RNA, 2115 nt, synthetic construct
  misc_feature 1..2115: note = mRNA product Design h-5 comprising derived and/or modified sequence from HRSV(Memphis-37)__AIY60640.1__F-del (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12426 - RNA, 2115 nt, synthetic construct
  misc_feature 1..2115: note = mRNA product Design h-5 comprising derived and/or modified sequence from HRSV(Memphis-37)__AIY60640.1__F-del (opt2)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12427 - RNA, 2115 nt, synthetic construct
  misc_feature 1..2115: note = mRNA product Design h-5 comprising derived and/or modified sequence from HRSV(Memphis-37)__AIY60640.1__F-del (opt3)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12428 - RNA, 2115 nt, synthetic construct
  misc_feature 1..2115: note = mRNA product Design h-5 comprising derived and/or modified sequence from HRSV(Memphis-37)__AIY60640.1__F-del (opt4)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12429 - RNA, 2115 nt, synthetic construct
  misc_feature 1..2115: note = mRNA product Design h-5 comprising derived and/or modified sequence from HRSV(Memphis-37)__AIY60640.1__F-del (opt5)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
